United States Patent 6,902,887 (METHODS FOR MONITORING MULTIPLE GENE EXPRESSION) - sequence listing, part 3

SEQ ID NO: 7602 - DNA, 953 bp, Tricoderma reesei
  misc_feature (1)...(953): n = A,T,C or G
cactcgctcgcttctacagtccagctacactcgttgtcagcaaacacaatccccccccaaaacaccaaaaaaacaaaaatcaccaccttctataatccaatccaccccctctcttaataccgccaagatgaagaccgcctttgttgcccttgccctcgccgctctggctcaggcccagacccgcgccgacatcccctcgtgcgctctgccctgcctcgacgacgccgtcaaggccaacaccaagtgctcgaccaccgactacgcctgcatctgcaagaacttcgacgctgtccagggcgctgccaccggctgtgtcatctccaagtgcggcactgacgtcgccatcaacaaggtcctgcccgcacccaggctctctgcgctgccaactctggcggctccggctcttctggctcttcctctgctgccgccggaccaccggcgccagcagaccacctctgccgntcaggagaccaccactggtgccagaccaccgttgcccagaccactgttgtcagctccgtcgtcagctttctcccgtccagacataccaccaccacccccgctggcccgttggctctggtactggcgttgcccccctcccgctggcaaccgnaccaccaccggngnttccactggtnccaccaacgccggntctgttntcntgcccggcttgcatgctcgttntcgggnccttgccntgtaagggacttttcaatcttgctatttgacgagtacggagcgaaacggcgtanttgagagagagagagagagagaaagatggcaatacccggaggaatattacttgntggaaggntantggaatgatgaatgagctggaccccggccaactttgggtgggatttggatctggcctttcgagggactgtaatacccaaaatatattaccagattactggcttaatgctaatgtcttcggacgcttttacgattta

SEQ ID NO: 7603 - DNA, 605 bp, Tricoderma reesei
  misc_feature (1)...(605): n = A,T,C or G
cgttaccgatgaggtgtccaaggtgcgcgaggagctcaagctgggcgatgtgtacggctgcgcgccccagacgtggtgcatctcgtgcgtgcccttcaacgactcgagcaacatctttcccggcgtcgtcttgcccgccgtctctgccattgttgtcaacaagacgcgcgaggataagtcgcgcctcattatcggcaacacgggggcgatccgcttcgacctgcaccaggggccgtttacgtatgatgacaacttcatcgtgtccgctttccgggatgcctttctgtacattcccgatgtgcccgatgagctagccaagactgtcctgcaaagctcaacagtggtcccattgcaaagcgtgacttggccacaatgcccgtccttgcgactngtgcaccgatccacttggggctactgaccgtcgcgagaatgcccaaaaccacggcgtcgtncgccgcaagaaattgtnacttcnggctatgttacgacccgntgactttggcaancgatggaaaccaacacggngcaaacaaggcatttganaactancttttgccgggcttacttttaaggncgaggtaactttgccgaagggaaccaccccc

SEQ ID NO: 7604 - DNA, 584 bp, Tricoderma reesei
  misc_feature (1)...(584): n = A,T,C or G
cctacaccgccggcacgccgccctcgggcgccctcgagggctccaagtcgggcggcgccatcaccgaagggcggcggaaaaggacaaaaaaacccgcccnaaagcccaccngtcaaagaaaaaagaacgccccccccggccaagtcgggccaggtgttccaagaangggcgacgacaaggacaagcaacaagcctaccggacaacgcaaaagtactggctaaccgaagcgcagcgtcggcgagttctcgcggacgtttagcttccccacgcgcgttgaccaggacaaggtgtcggccaacttcaaggacggcatcttcaacattacgattcccaaggnccgccaagcatgagcccaagaagattgccgtcaactaaaggggattttggtcgacgatgggggaatggatggatgggaattgtgatgaatttttgcatgaatcatgatgggttgttgggaatttgttcacgctcctttttctttctcttgatgcatcgggtatgggtggttttggcatgtatgcatgggaatcatgatacgagttacagcctttttggtgtctcttaacgccatcgataccttacc

SEQ ID NO: 7605 - DNA, 1007 bp, Tricoderma reesei
  misc_feature (1)...(1007): n = A,T,C or G
cattctgtcgccgatcagccaagcacagtcgctcgttcactcgtttacaagtccgagtacataccaatacaagtccaactctatacacacagttatacaactgccccaactatcaaccggaacaccagtcgccagcataactcgttcgcttctcgactcaaccatggctcgctcgctcgctcttctcgccttttccagcgccgtcctggctgctcaaaccaccaccgtcaagcttctgctgccctttgccgatccccagcctctcgttgcctccgtcgtcgccgcggacagctcggccacgacctatgccgtaggatgcccgccaggcaccgattccgatgagtgtggcttcgcggagagccaaaccatcactcagggcccatctacctatgccttcacgatggcttactctggagatgaaggatcttacaccgagattgcccattgcaagctctccagcgcagtcgacgtcgcctcttgcagcgcctccgtctcccaggacgacggcaacggcaacaccatggccaccgccagcgtcggcaccgtcaccttctggacctgcagctgcccgtcaccgtcaccgccggnctcgacaagctcaggccgttcccggcgccacggcaccgattcttcggttccaaccggcaccggaccggaccggttcttccgnagntttttagacgactgctgcttccggagctgcgcccacgacgctcgtcaggcagacaaccaccaccggcacccagaccggactacacgggcactcagaccacctcgtcgactgccgggcccacgacgaccaacgctgccggagtcctgaacgctcgcaacggactgttggtcggtgttgctgcattatcggcagcgccatgatgctgtaaatggaacngataaagacatgtctatgatgggttangaacaagcgttgagatttctttgagcaacgcgttgnggatcaattttgaatagggcttgaacaaangcntcagatgtcctggaaaaaaaac

SEQ ID NO: 7606 - DNA, 102 bp, Tricoderma reesei
  misc_feature (1)...(102): n = A,T,C or G
ngnatggtcntngttgttttctgtgtgaaattgttatccgctcacaattccacacancatacgagccgtaancataaatctttttttctttttgggccaacc

SEQ ID NO: 7607 - DNA, 380 bp, Tricoderma reesei
  misc_feature (1)...(380): n = A,T,C or G
attcggctgcgcctacagctactcgtccaactactcctacagctgctactccaccaccagcccaacaaccggcaagatggctctcttgggcggacacgagaagaagcacaaggtcaccattgtgggatctggcaactggggctctaccattgccaagatcattgctgaaaacacgcgagccaacaaggagctctttgaagaggaggtgcagatgtgggtgtacgaggaagacgtcagcatccncaagacgtcaccggactacgacgaggccgtcggcgacgcttcccagaagctcacccacatcatcaacaaatncnacgaaaaacgntaagtcctggccgggcattgnnctggccagcaacatcggtcgnccaacccct

SEQ ID NO: 7608 - DNA, 648 bp, Tricoderma reesei
  misc_feature (1)...(648): n = A,T,C or G
ataccccacccaccaactcagatcccttcaggtcaatccgactcgagcttcccacacccaccaaccaatccatcgacgtcaccaagcatcaaggcaccatcacgagaagcctcacaaaaaaaaaccacaccaaccacacatccacacaacccgaacccgaacctctctcaaccccaatcaaccccaaacaaacaacaacaaaaacaacaacatcatcatcaacatcaaacaatgtcaacacccctcttcggcatcgtccccgcggccaccccctcatacagccccaacctcctccccatcccccacatccttcctctacgccctccccacgaacaagcccttctccacatcgtcgtcttctcctcccggcatcgcctcccgacaactccgccgccgcgatatacctaccaccgcccgcgaggccgccgcagccccgcccaacttccgcttctcggcgcatcggcccggaaggagagcgccatgttaaggtcgccgccggcccggctccgagacgtaccagatgcgagcagtagccacaacagcagcagcagtgacgggggctcatgattggnatnttcgtcgagcccgcgacgccgtggcccgngctacaagaattggcgcaacaagcgaacaacacaacaagtttct

SEQ ID NO: 7609 - DNA, 757 bp, Tricoderma reesei
  misc_feature (1)...(757): n = A,T,C or G
nncattcactctttctttgaccaatctatactttgttcttcaagaacctttccaaaaacaaccaaaaagacaatcaagatgcgtttcaccgtcgccgctgctgtcctggccacctcggtcctcgcccaggagcccatctccaccgactacaccaccgagttggtcaccatcacggcctgccctgagaccgtcaccaactgcccggcccgcagcagaccacctccgtggcaccaacaccatccccctgacgacctcgaccgtctacgccacctcggtccacaccgtcgtctcctgcggccctgaggtcaccaactgcccggctcacagcaccgtcctgtccaccgagactgttgctgtctcaccaccatctgcccggtcgagggcacccagaccgncgtcccgtgcctaccacccaagcctggtccaacagcaccggcgtntaccccaccggccctgttggcggngagagctctgttccgtntncgtcccgtctacaagcattcccggcgngtctttttttccgtntacactggtccggntntccgtancccgtaacagcggttgtggtctaccggcttgtccgtagttttgtgcccgttgcccggagttcgtcgtgctgggacaanactaacacggcttacttggtgatacaaantgtgcgtccttgggtacggccgtggngggttccggccttggaccgggcgttntccanccacggcttgcggnangaacatgngttttctcgtagggggttgtt

SEQ ID NO: 7610 - DNA, 475 bp, Tricoderma reesei
  misc_feature (1)...(475): n = A,T,C or G
tcgtaacgaaacnaacaaatcagaaaacccaccgcccaacaaccttcagccccctcaaaaaccgccacaatgcccgtcatcgacatcaagtccaagcccgaattcgacgccctcacccaaacaacgccctacgtcgccctccaagcccacgcaacctggtgcggcccctgcaaggccatctccccgctcttcacaaagcacgccgacgccctcgccgtccccgaaaagttcgtcttcgcccgcttcgacaccgacgaggtccccgacctcgccatggagctcggcatccgcagcatccccgccttttacgtctttgaaaacggcgaagaaagagcgagacctcaccggcgccaacccgcctgccctgcagaaacttggctgaggctactgctgaaaagncaagacggcctaagtttctacacgccaaacngggacgaagacgaacaatanggtaaagtcggttgagaaggaggga

SEQ ID NO: 7611 - DNA, 267 bp, Tricoderma reesei
  misc_feature (1)...(267): n = A,T,C or G
nttccttctttccttccttccttccttntttncttccttccttccttccttcnttccttctttccttcttgnnttccttccttccttctttctttcttgctttctttctttcntgctttctttcntgctttctttaaaaacaaaggatannggggctagggnaaacccngattgaactggaaaaggttcggcgntccgcatctttttgaaccagaatacctttcaccctttggccttataattcctggaattccttcntttnacctc

SEQ ID NO: 7612 - DNA, 789 bp, Tricoderma reesei
  misc_feature (1)...(789): n = A,T,C or G
tcgcgcattcagtcgccaaccgctcattcggcctcggacctcgtgccaaaccatacagtcgaagacgattgcccactcctttggatatacacatagaccagcatcgtttcatcttcaaacagcacaaccaccgccaagatgaagttctctaccacctccgtcctgctcgccgccgcctgggcgtctctgcccaccccagcggccacgcccacaagcgcgcccacaactctgccgttgaggctcgcggcgacttcgtcatggccaacaagcccgccgaggctgctcccaccaccaccagcgccgcccggccgctntaccaccgccgntgcggccccagctctcggccccgcgaccgtcaagcccttctgcggcggcaacaagcaagcgcgccacggccgccgagatcgctacaanggcaacgtcggcgccggcggttctacngntgcaacatcatgaccgtcgacgagagctggtcgacgagtacaatacaccatggttttgagaacgccngcgacacacgacctgctttgntggaacaagatcggcccgacggcggatnaacggtttttnaaggcaaccaggccattaccttcacgtcgcccccggnggaagcangtcgtcgccgtcacaccaactccaagtnggttgngctgcgggctgnggncctgacttgaccccattcggcaattcgcttcacttgggtcgaggccganttgnaactgtcaacgnggnggtccgggcccatgcttntcttggtcgcgccgttgcggatgacatccccggcttcng

SEQ ID NO: 7613 - DNA, 728 bp, Tricoderma reesei
  misc_feature (1)...(728): n = A,T,C or G
tcacccctcctttttttttcctccttctccaacttcctttccacaccgnagacccgccgtcttttttcgtcgacgaccaaatcgcaatcatgtctcaatcaggagccaaggtttccccccaggtctcggagggagttccagaagctcaagcgaagcaacgacaagaaccgagctcctgagatacatcatcttcaagctgaccgacgaactactccaagatccgaggtacgagcacgctgagcccgacagcgactgggagaacttccgcgagaagctcctcagcgccacctccaagagcaagactggtgctgttggcaagggtcccccgctacgccgtctacgacttcggcttcaagtttgacggncgagacatcaacaagatcatcctcattgcctggtctcccgatgatgccggtgtccaccccaagatgatctacgccgccttcaaggaggctntnaagcgatccctggaaggattcgctacgagatccaggccaacgactctgacgacctcgagcactnttctatccttcagcggccgtcctcgccaagaagaacgcataagcgacacctggacttacgacgatctgatgcagtgatgcaaggggatgcgagggacagctnccaaccgggaagnaaaagaagggaggcctggccgngngtctttggttaaaaatgggcgtgctggatcgaggggggctntgctttttccgtgggtaggcatgggt

SEQ ID NO: 7614 - DNA, 473 bp, Tricoderma reesei
  misc_feature (1)...(473): n = A,T,C or G
ccgcgtcgcctccacgtcgacgcaccccgtcccttacctcggccccgtgggcggcagagcccccgagcacacgcacctcgcccagctgaccgacgcccagctcctgcagacgtggatgtccaagccccgcgtcagcgagttctggggcgagtacaagccgggcttnctcgagggcgtcctgcggcagcggcactcgttcccggccattgcgctgtggaacggcatcccctttggctacgtcgagatctactgggtcaaggaggacatnctgggccggcncctggccaacggcgcgggggactttgatcgcggcttgcatgtctttgttnggngaggaatgggcgaggggcaagggtgccttgtgtggttgacnagctttggtgcagtggtggcttttcttgaaacgataattcggaccatgaaccgtttggcttggaancccgaggggttgataatangcgcatgtttgcggt

SEQ ID NO: 7615 - DNA, 735 bp, Tricoderma reesei
  misc_feature (1)...(735): n = A,T,C or G
agacgcccacaccgtcttcctcgtcaccaacttctgggagagcatgtccgccgccaccgagatctcgcagggcaaggccgtcgtcgacgccagcaaggccgccggcgtcgagcacatcatcttctcgtccctcatcgacgccacaaaggccagcggcggccggctgcccaacatctcgcactttgacggcaaggcccgcatcgaggagtacattcgggccaccagcggcgtcaagggcacgtttgtcctgccgggcatgttcatgagcggcttcacgaccatgattcgcccgaatccgccgtcggagccggctgggtatacgctggctttgccggtcgacccggataaggcggaggcgccgttgtttgctgccgctgaggatatgggcaaatttgtcaaggctgctattaaaaacttcccgttgcaagaccgggaaccgcatcctcgcggcgacagactactacaccattcaccggctcatctcggagtttgccgaggtcatgggcaagcctgcgcacgccgtgcagatccagacgacaagttcaagtcgttcctgtcgcccggcggaagcgcaaganctgctgganaacatgaagttgtggaaggnccanggtattatgctggcgagagtcttggggggctaattttggcgttggtggaaaaanaancccacgacttggaaggagtttgtnaanaaaacattaaagaagaagtggnttttacttttacccttga

SEQ ID NO: 7616 - DNA, 720 bp, Tricoderma reesei
  misc_feature (1)...(720): n = A,T,C or G
tgtttgaatcacgatactcacatgacacgctactagtatcagccgctcaactccctccagcccaccctcatcgcaacaccaccacctcccatcaagcatcatcatcatcaccaaccccccaaaccaacacatcccctcccctccaagccccgctacccacctcacccgcaagaatgaccgacggcccaatccgcctccgcgaaaccttcgcctcgacgcccgtctccgcccacaacgacgcctgggacgccctctacgcagagtccttccacccctgggaccgcgccggaccctcctcgcctcgcgacctgctcgcccagcgaacggacctcatcccgcctccgtcgaagcgccgcgactcctctcctcttctccggcacggcctcatcgcccgccgctggcctggttcgggctgcggctcggcacgacntctgctgctgatgcctggggtacacgtngtcggctggatnacagcgcccgggcgttgagctgcgcgcgagaacaaggncaangcggatgccgagggggcgatatgccgantatgttaggggccggcgttggcaagtggccgggtgnntttgggttttcggcgaattttttnggacttgcttggggaagccgacgcgggcgnaacaagtttgacttggatattcgnanacacgggggngccaccgaacgaaaanggaaaaagnganggaaaanaggctttaaacaagatga

SEQ ID NO: 7617 - DNA, 771 bp, Tricoderma reesei
  misc_feature (1)...(771): n = A,T,C or G
gcggaatactacaaggctgctcagtccgacctcgaggcgccgccggagatgaagccctgggagcggattctgccgtctgccaccgtggtggccctggtgctgggcttnatcgccgccgtcgccatggtctacgaggagccggcgccgcggtacaggctgttccgggaggtgtngacgtcgcacgctaccgtgggagccctcatcgccatcaatgccctggtatatctgggctggaggataccgccgctgtggtctctcttcaaccgctacatgatctttgtcgtggccactgtcgacccattacgctgttcaccgcggcgttttcgcataccaagcttagccacctgttggtcaacatggtgcccctttggttcgtcggaacgtgcctgcacgacgagattggacgcgcggacttcctcgccctctatctcggatgcgggtcggtgggcttcctcggcagcttgatcacgtacacgctcaggggctggctgacggtaacgtctntnggcgcgtcggcgcaacgctggggctgtgcttnggctacttttggaacatcgaccggatgggttcaaganctttgggcttgcccaaggatggtgtccacggnattgtntttntggcgcttaatcgcggcggngcaagttgaanccggcttggggaanacgggaaacntaaaggnggacattgntttccatatcgccggtatgattgntgggtatttttggggattgacttcttgaataggaaaaaaaggaagaanaccccnccgga

SEQ ID NO: 7618 - DNA, 896 bp, Tricoderma reesei
  misc_feature (1)...(896): n = A,T,C or G
gcctcgaagaagctcccgcggacgacggcaccgacaatcacctccacaaagggccgcgcggttccctcactcggcgagattcctctacgtcttctcacgccgatatccagtcgatccaggagggagccgagatcaagggaaagattgtactgctgatgcgcggaggctgcgggttcttggacaaggtcatgtgggcacagcgaaggggtgcgattggcgttattgttggcgacaacatcaagggaggcccgctcatccagatgtttgctcacggcgacgaggtcgacgatgtgacgatcccctccgtcttcacaagcccggacgactgcgcagctgctctcttcactgacgcaacccggcagcttcatcgaggacacgctggacgacaacggcaaccccgtcttcaaagtacaacagggctcgaaagccaggaagagcaagagcccggcttccaaaaagaagacaccatcaagaagcccaagagctcaagcaaggaaaagcgaagcacaagcgcaaagaaaatagaggccgaggatccgccaatcaattggttctcgcgtcttcttcagctgggcacgtnttntcgcggcgtccacagcgaaagcagaccgccacagtggacaagctggactgggttattggtggaagactggaatgacgagcaggataccaccatcaagcccagcacgggtaaaccaaaagaaacagccnaagcgacccaaggnggagggcgacnatttttgattggggttnaggactggcgtgaccttgattttttgggccaaagccaaggtggcggttggangaagcaaggacccctttaggcaagtccaatgccaaaagcggngtnttcgaccaagaattttggcgccgatgaacccaangganggaacctt

SEQ ID NO: 7619 - DNA, 611 bp, Tricoderma reesei
  misc_feature (1)...(611): n = A,T,C or G
aaatgtccgatagcgacgacgagcccatcaccctctcctcccacgccctcgaggccctccgcgcctttgaggctgaacgcgaagagcaccaggccaagttccagaagctccaggccgaggcggagagcaacaacagcctgctctccatcgacacctttgccgaggactggaacgagtctcagttctggtattcagatgaaactgcaaataccctcgccacggagctgctcagagatgcaacgagtgacatgaccatcggcgtcgtctctgcgccgagcgtctttgtcgctctcaagaatatactgcggagtaaaagcgaccatgagaaaccaaagctggtnctgttggagcacgacaaccgcttngggcgtgttcccagagttttcgttctatgacttttnacagncagttnaaattggcaaggccatctgaaagggntccatcgacaagaattatttggngaccccccattnttgaaccgaanaatngccaaaaccaaagcccgccttgaccggttcggtggntttttnaaaccaaccggggggccgggccggcancttggttttaattggttnggncccggnaaaanaatgggagtnttttnttcttta

SEQ ID NO: 7620 - DNA, 929 bp, Tricoderma reesei
  misc_feature (1)...(929): n = A,T,C or G
actaacaacaacatcgtcaacacttcagcggctactgtattcacttactcgcgtctttgctgtcttacacgcaaaagaacaaaacaagctcaactcgctcacgccttttttgaatcacacccaaaaccgtcacaatgcgtttctccattgtcctgtccggcctcttcgccgcctggctgccgcccagtcgagctccagcgctgccaggccccgtccgggacccagtcgctcagccctgcccaggcctctcaggttgcctgcatcaaggcctgcaaggctggtgacgttgactgccaggctcactgcattgctgtgccctcgcccaaccagtcccaggtcaacgccaccacgcagtgcgtcgccaagtgcccccagggcaacggcagcgctgcccagacgcagatctacaagacgtgcattgacaagtgcatcaacgaccactacttcgtcacctctgagggcactccccaggccactggcgcccccggcaacgacaaccaggcttcgggcaccgctactgactctgccgttgcttccacgggcaccgacaggttcgcgactgacttcgagtccactggcaccgggactgggaccgcaccggcacgttgactcgcaccagcacctttaccaggaccagttttgnctttggtagcgccacgaccaacgctgcttctgccatgattggctttggcggtgctttgatgggtgtttttgttgcctgttggtttgtaagcacacctagtctgagtggttcgcagatgctgttgctttttttttacaagttcttggtccaagtttnggttgggctaatggaanggggttaatcttggttaatggtctaatgatggagatnggtgtatttacctcgagtttgatatcaccgggaataaccgtncctaataaaatagcgttggaacccgaaaaaaaan

SEQ ID NO: 7621 - DNA, 583 bp, Tricoderma reesei
  misc_feature (1)...(583): n = A,T,C or G
caagtactcgagattttgcgaggaggccttcccaccagtgccgtcaatgcccctatcatcctgcccgaagagtaccgcaagctccaaccctttgtgcaactgattgagaagatgggccgtctctacatgcagcatttcgtcaggtccaagggaggcctcgttggcggacgcacctttgaactggtctaccacggcgacctggctggaatgccaacacgaaacccgctgtacccagcgctggtaaagggcctggtcncttcttcaangagactcacgttaacattgtcnacgcgacgcttgattgccaaagganaagggcattaaagataagcgaagacaacttccaccaccaggcgaacaagacgtatgccaacctggtgacctnaaaggccacccaaaggacggnagcgggcaacaaancaatgaaggctaccttcnggcaaccggttgnacattttncaacttgaccggtttaacgccanctttanccccgagggcacccattgatcattcttgnacnactatgacaanccgggccaagaaatggaggncgtcgncantggtgcttgggcttccaccggat

SEQ ID NO: 7622 - DNA, 716 bp, Tricoderma reesei
  misc_feature (1)...(716): n = A,T,C or G
ctcgttttgcggcctcgttttttttttcctttgtcccagcaacccgcaggatttcgtctactatcaggtattgcatggcatctcctctctagcgactcatagctttggccgactctccatctatccgcccccttcacgatgcgcctgccggtggctctcgtcctcggcgcgctgcttggggccgcccaggcatctgtcgtcgtccgacaggacaacgccggcccagattcctccacggctcccgccccgaccgccggagctgacgactcgtcgacctctgcgccgccttctcagaccacgccgcccccgagctcgacgtcctcgtcctcgtccagcagcagcaccagcccggccgacagcgacaccaccgtcttcgagaccgagaccgtcacgggcgcgggcggcaagaccgtcaccagcacccgcactctgacggcgacgagcggcaccacggttgtcgtgacagccaccgtctttgtcaccaccactgttactaagcagcggcggcgagacagccaccaaggtcgtntacgaaccaccaccgtcttcgcgacgcccaccgacagccnggccgcccagaagcgcgctggcgagattgcgcctaggactggagtcgcttgccgctcctaccggtgcccccgatgccgaactatntggcccggtctntggccttgggcgacctggangcgcgccgcatcttnacccgaggtcgtaac

SEQ ID NO: 7623 - DNA, 645 bp, Tricoderma reesei
  misc_feature (1)...(645): n = A,T,C or G
attcccccatgccggggacgtatcccgccgaggtcagcgagtttgacacgagtctggggctgaggctggattacgaggcgtgtttggcgtatcttgcgtttccgcctgtaggggcggtgattctcttgatcttggagcggaatagcgactatgtcaggttccacgcctggcagtctgctctcctcttcacagccatcatggtcttccacgtcttaatctcctggtcgtccttcctgagctggatcttcttcctcggggacattgttctgattggatttctcacgctgaaggcatatcaagacgcagaagatactagacagatacgaagttcccttcttcggaaggatagccgagcagattcctagacgacgaagtaaacgttagagcggcgcgcgcacgcttttcattncatttttttttctctctatgtggctctgggctgggctgggttggatgtaaaaggatggggcttcggtctggttccggctttgttctcgtgtcnctggacatcttggttggatgcccatgcatggttctggcccctactactacacttaatataccccctgttctctggcgacnttatacaactggttgcagcccatttcaaggttccgaaataaaccatgtggtatgcttggtcct

SEQ ID NO: 7624 - DNA, 653 bp, Tricoderma reesei
  misc_feature (1)...(653): n = A,T,C or G
tctcttcaaataacaagcccggtgctctcttgcccactgctctccctcttctacaacatctacaagccgaatatcgagccttacgagtccagtctcaacacacccaaccgtcaaaatgcagttcaccaccctcctcgttgtcgccggcgctgccgttgccgctgctcagagcacctcgactctgactgccacgaccaccatgacctacaccatcacccagtgccccgagagcgtcaccaactgcccttaccgcacccctgccgcagcacctctgaggccgctgcaccaccgcgcctgttgaggtcaccacctctgccgtcgagacctccactgccgtccctaccacctactcccccatctggagcgtctccaactcgacctctgcaccggtgttggaccaaccccgttggaccggcgttccaccaccattgtcatggttcctntggactggtgctaacctaccggcctgntggcaacgttccttcggccttntggccctttgggatggcccccttaccgtccttacaagcggngttgcaaacanatgggttantccggcgtcttcntgtcgccgtccnttgccgttttcgcccttggctttttaagcgcacatttacacttttttttaactgnttggngccaacagttcaata

SEQ ID NO: 7625 - DNA, 777 bp, Tricoderma reesei
  misc_feature (1)...(777): n = A,T,C or G
tgtatggccccgtgtggaactacatgatggccgggtgtccggccgtcgtgggcacgctgtgggacgtgacggaccgcgacattgaccggttcgccggcagggcttttgaggaatgggggctctttgccaggggcacgtttgacctgtcgacgtccttgtcgggcaaggccaaggccaaggccaagggcagggctaagagctttgccgaggaggtggaccaagtgaggctcgatgctcctgcttcagatcatgcttcgcttgcggaggcggtggcgagggcgagaagcgcgtgtcgcttcaagtatctcaacggcgcggcggtggttttgtatggaatccctgtttatatcaagaaggagtgaaaaaggactcttggacacgatgacactacctgggaaaattggctttgggtnaaagggaatcgagccgggataaaattctacaaggggctaaacggtggaaagaacgcaaatgattctcacaataaccgagatacaaccgaactaatgacatgaatgacgaccagaaagcaaacacaacgatgagagtactatagcgtttcttttggaaagatggcgggattggacatganaaaaaggcgangaaggcattgcttgctttattgcttttgaacatcttttggtcttngccatagcgtgggggaagtctttggtcgntttttgggaaanatgaaattgaatnggattttgatgctattcaanacacttttggacgaaaaggggaaaaatcntgatttccgggngggttngaaaaaaa

SEQ ID NO: 7626 - DNA, 513 bp, Tricoderma reesei
  misc_feature (1)...(513): n = A,T,C or G
acactttcaacaacaacaacacgcaacagcaagaccaacagcaacagcagcagcagcatcatcagtttggtgatttcaacaacagcgacattgacagcagcaacgaccagaaccaacacaccaacaacctgctcttcgacgacttcgcctttggccaggccgacaacgactttgagttctcgccatcgtccttctcgtcctcggagctctcatcggccaatctcgagtatctcaacgccgccatcgcctctgccttcccgtcagactcgatgcggcctgactcttcctgggacaccgccgctcgctttcgactccttcaaagttcggccgtctcctaccaagcgcgagtcctctttgcgtccctcgggttccacgggggccggcggtcggccctttaacttcgcacatcggcgaaacccttcacatnggccgtttaccgacgnccaatgggtgaacnggntttcattgggacattgcacttcgcacgaanatggttttggccattgaacttta

SEQ ID NO: 7627 - DNA, 539 bp, Tricoderma reesei
  misc_feature (1)...(539): n = A,T,C or G
atgagtgctaccgcaagactccattccccccatgagcttcctctccgcgctgaggctcgtgttcccacaatttgccgaaaagtccaagagcggctctggatatgcccagcaggatgctgaggaggcatggtctcagattgttcagcaactgggccagaaggtcacgatcaagtcgtcccccgatgagcctggtgtttctttcgtcgacaagtacatggcaggacaattcacttncgtccttgagtgcgatgaggaggaagcgcggaacggtggcgaacaacccgtcatctcgaaggatacctttacaaacttgactgccatattgacagtnagacaaaccacctgagggatggcattctggctgncctcagcgagaagttggagaagangtcggangtgctgggccgtgacgccacttacaccaagacgtccaagaatatcccgagcccccaagtaccttaccgncccactttggtncnattcttttnggaaaaagggaaacncaanaagaaaggccaangattattcnccaanggtct

SEQ ID NO: 7628 - DNA, 538 bp, Tricoderma reesei
  misc_feature (1)...(538): n = A,T,C or G
ngctttttgcaaggttctgatttgtgagctgaacacgatcgcaaatgtcactcgctgcctcgacttcttcgtaataccatccttttgcgcaaaaccacgctcgtttcgagtgcgaaacaggtcctacggagaaaacagcgatagggaactcgcgaactcaaactacagtacagcattatctaaacaatcccttattgctccggctacggaacgacaataagccgcatcggctcatcatgataatcgacaagatcccattggngttgttgtttggtgctcgcatcgcgctaggtgcggatctccaacccatccagatcaagggctccaaattcttctacgagaacgggactcaatttttcctgaaaggaatcgcgtatcagcaggattngtctgccaatgggacagactgcccacccgacacgaaagttacccgatctctggctaatggaagcaaactgcaagncgtganatccctctgcttagnccgaacttggggacccaccnggaacccgaccttanggcgaancgatccgaactg

SEQ ID NO: 7629 - DNA, 748 bp, Tricoderma reesei
  misc_feature (1)...(748): n = A,T,C or G
catcatggcctcattcgccctctccgccccagcaaacaccgacgtctggaagaaacccccctcccacgacgtcttcaccgccccctacaaatccctctccaagaacccctttccaaaattccgctccgcaagcctcaccttcacagcaacatacacccaccaattcgaccaagccggcatcctcctcctcttcacccgtccctcctccagcaccccccgcaaatggatcaaagccggcatcgagcacttcaacaacgcgccccgcctctccaccgtctgctgcgacaactgggccgactggagcgtctgccgacgtcttcctcttccgcggcagacatccaggccggtgccaanggccgtgaccattctcgtggagaggctggatgcccatgacgggtcgtgcttgtgggtgtatcngggtcaagggcgacaagaagacgccgatgaagggagaatttgctggccgtatggcgaataatggggggcaaggatgggaacttggaaggtttggggcccttggtnggccaaggncccaattaanggattgtgaaaggatgaacttggganggtgaaaattttgganggggattcgaaggtcaaaaggggggaccaatgctttaaaaggctgctgcttnttnttcaaggnatcatacattccagacactttggcttatggnatttggtggtttttttncaagggttttcatcataggtaggcttatacacaagaactcatgatagtcaccgg

SEQ ID NO: 7630 - DNA, 864 bp, Tricoderma reesei
  misc_feature (1)...(864): n = A,T,C or G
cggacgacaacaaacacgcctctcgtttctcttgtgtgccgtcccgagcagtgcgtcactcgtttcagcgcactcccagcggctcggatctgtttctgctccttgcctgttcagcactcattgccggttcatttcttttgcgcgacaccgacttccaattccccagcgcgtccgactgggcttccaatcgctcgaaaactgctcgaaagaagaaaaaaccagcgcctcggttacacgacacgacgcccgagcccggcatcgccttgggcatttgttcgacgacagcgacattccctgcttttaaatctaaatcgatctgtttctgtggcttcaagcccttggggagcgacaagacgcacaagggaccatgcgacaagtccgccgtgggttgttgccttctgggccgccggatcgggctttgcggctggcgacgtgctcgcttaccaagaangtgtcccaaggagtcgccctgctgctcccaatatggcgaagtgcggcgtcggcgcgtactgcctgggcggctgcgacccgcgaatgtccttctcgctcgactcgtgcacgcccgancccgtgtgcaagtncaagacgatgacgttcgactncaagcttaacaccatcggcgacattnagcgactacctgggcgacccgttcacggccgagtggatggccaaggcgaagcccgcctactacacggnaacgtgnctgntgacattgccccaanaacaagggtcggcaccgtctgggcaccacccgagtacatgtgggaccgggaacgttaaaggcaantttaaaaacaanccgnggccggggcgttgtnacggcctttttcttctgtcggaccttaanggacaanaattgacttt

SEQ ID NO: 7631 - DNA, 755 bp, Tricoderma reesei
  misc_feature (1)...(755): n = A,T,C or G
aggatgaggacgaggatgaggacgaggacgacgaactcgatgttctggatgtcgaggacgaggacgaggatgaggacgaggatgatgaggacgagatggacgatggctccgacggataccacactgatgaagagaccggcttcgctgattccgacgaggaagatgacgaggacgagaacatgatcttgtggactccgggccgcaccccatctgccctcaatcaggtcactactagcctggctcgccgtctctccatgaccgagcaacactcggactcctctattggatcccgacgcagccgtcgccgatccaagccccgtcccattggacctcaagtcgaggcgccggacttgcccgacagcactgactttgtgtgcggacgctcgacgaagatcgcctgttgaggatgcctacctctcgtgcctcgccgcccgcaggaacgagaagctgcgcatcatcccccaagacattgatccaagcttnccngcttcngaccttgaggaagangacgacgatgatgtctacgcngntggttctgacagcgacgatcacgcttgggtccagggagccatggaggatcttgatgacgagacaaacccgcctcgaaggangcgcaagggcgaagancaccttttcccgacgaattccgttnttccgcttnccaagcgacgcgggttttccgccccaaaccttgcgcacgcttttccaaccgtttttgaccgccagtcgcttgacnacttccttcctgngcccaa

SEQ ID NO: 7632 - DNA, 315 bp, Tricoderma reesei
ccgacgacaaggatgcggcagccgccgacgccaagaagaagcccgagaaggagaaggttggctacgagattgagaacatgagccgagttctacctggtcagctcaagtacatcagcttccctgctggccgttataagccagtcaagaagccaaccggaggtcctcttcttcttatcgatacccagcctgacgagcccaagacgcttcttgaggagaagctgaagaaggttacgaccgagcgtgcgccggtcgctggacagcagctgggcagaagcggagctggtcgctcaagccgatccctcctcgacgatccca

SEQ ID NO: 7633 - DNA, 903 bp, Tricoderma reesei
  misc_feature (1)...(903): n = A,T,C or G
ctttcggcaccttttgcgggtttctacaaggagcgacagcagtgctttccatccgagaaacgtggattaccacctgataggaagcctccaggatcttcaggctcatttccacctcagtcagctccatcttcccaaagaaactatcagcgtcgtcacagatacccgctacatgttccagcccgtgacgaggctttccaagtcaaagggaaaggtagatgtcgcgatcaaggtcggaagccagtttgtccaagtaacgacgaccaagaaacaggaggtcttgtctggtctccgtcttagtaccactgtcaatgacatattccggctaggggacgtggaggaagcaacgacaacactgcagtcagaggatgactcgtcctttggccttcgcgcggatggtgggaagattgtgatgtacttctccagcccaaagaaggccgacgtgctcagaccatccgcagcgccaagagcaagcatggaaaggagaatcgcacctacaagccgtttgagaggcttatgcgtcccaagacgtgccggggacattgntcaacctcgcttcccaaccttttgagtncagatcgcgctcttgagattggcattatacaatttgctaggagcactntgnagggcctttaaattcagcgcaaattncagattggcatgtgccaaaaacatttcaatttccatggatccacaaaanttgngggtgaaatgagcaaaatcctggcaagcccgcagccncagntgaatttganttnttgacggagttnttngttggtgggaanctttcctgaaaacaaaggccgttancctggctttnttgtaccgggggttgggggctttggaccaacatttttgacaagcgaacaanaaagcgaaaaggggcaaaaaaanggcncgaccttt

SEQ ID NO: 7634 - DNA, 500 bp, Tricoderma reesei
  misc_feature (1)...(500): n = A,T,C or G
caaccaccaccaatctcaacgcgctctttcgagccaccaacaagctctttttatgctcaagcgatctcttcttcgcagcaacaacaacaagaaccgcatcatcaagcacctctcttcctcttctccaaagacttccacctccgtctccgccacacgactcttctcaaccgcacccaaaatggccttcttccagcgcaacttctaccccgagacctccttcacccccctgttccgcctgctgcaggactttgacgactactcgcggcagacaaacggnggttccgcgtcgggcccgccgcaccggcatcacgccatggcagccaaagttcgacgtgcgcgaaacggacgcccgcgtaccaactgnacngggagctgccggnatgaacaangagaacgtnaacattgagttcaccgactccaagacgctngtcgtcacgggcgngtngagcgcactaaacggcggacgcgccttgggcgccttganggctcaagttgggcgg

SEQ ID NO: 7635 - DNA, 835 bp, Tricoderma reesei
  misc_feature (1)...(835): n = A,T,C or G
ggcgagagggcagaaggacgggaatccacgcgccattcagctcggattgactcagagccggaaacctcgacaaacctcgatcaagaccattacctcctacgatcaagaatcctgtaccgtcttccacaagccactgaatcctctcaacgactgtacaaatcaccgcccgtcaccacctcctcatcgcctctccccccatcatatcacacaacacacacaaagagagaagacaaaaagaacaaggaaaaaacacacaagatgtcgtcctcaaccgccggtcccgcgcggacccccgggggcgacgtcgacgcggcgaagctggccgtgctcaaggagctgctgtacgagcgatgccgcgaagagggcgacatgttctcgcaggacgacctgctgcgcatggacgtgatccccaaccgcgacctgctgctgctggcgcgcgtggtgcagtcgctcagcgacgacaaagctcttcatcacgatgagggaggcgtcgggccaggtgctgtggaagtggcgcgacaagcaggaggcgcacaaatacaagcagtgcacgacggacgagcaagtcatggtctactcgctcatcgacgacttcngcggngacggnatctggacgcagacctccaaaagcggggtcaacatgcacgactcggtccttcaagaacgcaattaagcagcttcaggcaaangggctnattgcgccctttaagaacgtcgagcaccccaacaagaagatgtacataanggcttcattcggccgaacgaccgngccacgggagggccttggtacaccgatcaggatnttgacnaggctttattgaggacttgcacgcgt

SEQ ID NO: 7636 - DNA, 610 bp, Tricoderma reesei
  misc_feature (1)...(610): n = A,T,C or G
ggaccgcgtgccccagattcatgaactcaacaacatgtgctgcggcctgtacgacgccggcatgttcacccagatggagatgcacgtcctcaacaccctggaatggaccattggccaccccaccgtcgacttctttacccagctcatggctgccgaggagcaggacgacaaggaggtggagcacatggccgcctacctctgcgagattgccctgtaccaccgcgatttcgtttcgaccaagtcctccatcatggctcgctcctcattagccttggccagggccatcctgggaaggcccgagatcaacgacggcgactgggaccacaccgagaacctgacgctcttgaccctttctcagcacctcaaccagccctcgccgaccctggcccgcaagtactcttcatcatccctgtccaaggtttcccagagctggccgacttcatggccgagcaggccgcgatggacggntccaggccaacccccagtcgcccctgccgacctgtctnangcactccgacatctacagaccccccaaaaggncacgggctgccggcnggttcgacgggtacctnacgcctccatcaccccgacaacgcctacggaaacacgg

SEQ ID NO: 7637 - DNA, 673 bp, Tricoderma reesei
  misc_feature (1)...(673): n = A,T,C or G
aaactcgagcaaagccaccatgtgttccgccgacatcttcctcggcgtcctcgccatcctcttccctccgctgcccgtctgggtcaagcgcggcatctgcagcgcagactccctcatcaacatcctcctctgcatcctcggcttcatcccaggcctcctccacgcctggtacatcatcgccaagttccccgagccgccctacgaatacgacgccgtccccaacgacgagcgctacggcaagcaaccgcgtcacctacgtctacgtccagtcccctcccggacctcaccaccagcagcccaagccgcaggacggcaacggccgcatgaactacgggacgacctcgcagctacaacaccacagcccgtcgctcagccgcagcagcatggggtgacgggctcgggagagggcagctctgatcataccagggtgtgccgccttcgtatgctgaggtcgttgctggcgaccacaaggtgcagacgcgtgattaatggaagacaaagagataatgatcgtatgccgccatcagcccgaatatgtcaaatgataccccaatacacatgtacggaggcagaaaccgtggcggcgatggagacgcgtgatatgctgcaacgaaatgngggcgaatagaaagtaaaaaaggngtttgctcttcaagacttttgttataaccgg

SEQ ID NO: 7638 - DNA, 795 bp, Tricoderma reesei
  misc_feature (1)...(795): n = A,T,C or G
cgtccccaagtttatcacgaaataaagaaaaaaaaaataattaaataaaaagacacactcgccgtcaagaccaagatgcgccagtccatcggtacttcgctgctttacctcatcgggggagcaaacctcgtccttgccgcgtgcgagaactacagcttcacgacatgcgatgatggcattgtccactggtacgatctgaaggacggccagatctgcgaccccaaggactgcggaggcggccgggctcctcccagaaccgacgtgccgggctgcccctgtattcgggcacgatcctcagcgagccgatctcgtacctctcgtgcttcactccgtcgaatgccgtgccagtgacgacttcgactcctgctggcagtgctggaacaactgccgatgttgtaatcacaagcgccatctcgacctctgacgctggaagaacgacccaggagccggcgagcgagaccagcactgtcgattcgtctgtcgcttccggtaagccgtcgaccttgatcacgactgctgcctcttcgcctgcttccgcttcgaccaagacttccattacgagcccgggaactnttttcactaagagccaagctacccacgcaagctttaaacacaacgaagcggnagtgcttcaacgacgtcgactacgaacgctggaaatggcggngggtggctcaatggttggccgnggctggagttgcccttggacttttgcttttgttgaaaagcaaaggggtttgggttgtaaanaggtattacttgtcctaacncaaaaaggaatcaaattttgtggac

SEQ ID NO: 7639 - DNA, 898 bp, Tricoderma reesei
  misc_feature (1)...(898): n = A,T,C or G
cgagttcctggccgactgcaaggcgcagctgcgcgcgcaggtgccgcgcatcgccgagctgcggcgcaaagccgccgaggacccgctcgcgttttacgagggcgagcgggccacggacggcagcaacaacaacaacatcctcgacgacgtctntgtggcggcgagctcgcgcgtnancacgtcggccagcctgttcacgcggtacacggggaaagcgggcancgtggggacngncggcacgggggtcaaccgggcgaccancaaaaaccggcggcgggaggaaaaaaaaccccccccggcccgaagggcaccgtgtaccaagaggantacctngtcaataacctgcngcggctggtggaacncntggaagccttcaaagcggaagtcganaggctggtgtttgcgctcgtgaagaaaagcatggcggaacgggccaagggcccgcggaagcgctnatggcggatgtcacaaaagccttgtgaaggtgctgtcaaagatgtatttgccgtgtcgggtgagcaacaacaggcacagcagcaggaacatatacagatacagacgcatgctgatgaaggggtgcatgcgtggaangcctcgggcngggaaggcgtnttttaagantgggatgcaagaacaactgcanggcaagaanatggaacccgccgtgatttcngggatgaanaacttgtcctgcttgggatgatgatgatgatgatgatgatgatgggggaaccgantntgggaactgggttcttgatttttttgctgaggnatgatgttgcatgtatgtccaaaaaanatttttatttgggngcttnaataaaataaagggggattgggagggggaaaaacttcctatgaatcnttccaattccccncttaaaaaaagaaaaaaaaa

SEQ ID NO: 7640 - DNA, 573 bp, Tricoderma reesei
  misc_feature (1)...(573): n = A,T,C or G
tgctccgcacaaccctcaccaagacggcncgctctccgtcccctccgcgccgcattcaccaccactgcccgcgccatgggcgaaggcgacactggcgctccccccaagaccggcggccaaggcgacgccttccagcgccgcgaaaaggccgccgaggactacgccatccgccagcgcgaaaaggaaaagctgctcgagctcaggaagaagctgacccgagcagcaggagcacctcgatcgcctcgccaagccattgacgagattaccaaggagcagggcggcgaacaaaactaaaaggaatttgttgtaaccggaccttgcacgaaaaaaaaangcagacgagtcgctcatcatggcatgagggcggcttgactgggcagttcaaattgtattattaaggtagaaggcaacaacagcccttcgggggtccgaatcgcgcatacatcatgattgcgttatctggctcatcgctagccacgatccgtctgtaaagctatatgaactctnttcacttnttggaggaaaagaaaaaagaaaaaaagaaaaataccccagtcccttcgaanaaaaaaa

SEQ ID NO: 7641 - DNA, 406 bp, Tricoderma reesei
  misc_feature (1)...(406): n = A,T,C or G
ggacgatccgggatatcgctgctcacccgaccaccgcgggcacgttgtatgtctcgaccgacgtcggcatattccgctccacagactcgggcacgacctttggccaagtctccaccgccctgaccaacacctaccagatcgccctgggtgtgggctcaggctcgaactggaacctgtatgccttcggcaccggcccgtcaggggctcgcctctacgccagtggagacaagcggcgcctcctggacggacatccaagggctcccagggcttcggttccatcgacagaccaaggtcgccggcagcggaagaccgccgggcaagtctacgtgggcaccaacggncggggcgtntttacgcttaagggaaccgcggcggcggcacnggccggaacttcctcgtcgaccaa

SEQ ID NO: 7642 - DNA, 285 bp, Tricoderma reesei
  misc_feature (1)...(285): n = A,T,C or G
ncttggcaaaacatgttccgacacacgangcggngcctggctgntgcngtggncaaagctgtcgagcccagcgcatacactcttgccntgtcgngggcgcanggcgttnctctagggctgactggagccatcngaaacacgcccctcatgacctcaaccgctctcngaagagacgggctgtanatctcgggaggncgagttatgaaccctgcggatgatcaaggaccgcgcaactgctgtacgtcggcaaggacgccgaggagctgcggcctgctcaagccgggc

SEQ ID NO: 7643 - DNA, 775 bp, Tricoderma reesei
  misc_feature (1)...(775): n = A,T,C or G
caggaagcgggcggaaggnganaggcggccccgggtcaagcccacgtcgccccagcccgaagacaacgacgagaacctcacgccggaacagcgacagaatcgcgaaatcgacagggctctcgacgccgncatgaagaaccgggggtcagcgcccaagcgccggagaaaggacgagattgatctcgaggacnaaatcgacgagcaagttggccgcgctcaangtccagatggaccgtgcgtgccaaggccgacaaccagggcgccgcgaagtcgggacagcccgccttgnacaagcttcaagctggttgcccgaggtcgccgggcctnttnaaccgtaacaatggttnagacgccgtggttcgatcccncaccaantttttgcagacgtnaagttcttctcaagccgtcaacgacggttcnttgccgcttaaacatcaagcgcgacatttnaccggccttgacgcgcttaacattgaaaaggangctnttcttaacaagcngnattcggnaaggtcgttttgttntacacgaggagcaagaagccccgagcccancattaaagcccatgggccnaccggttgttgggaaaatggaacccgcccattcttaagccggaccgacgactacaagaagcgccacatttganacccncgagttttgataccaagnttgccaaanttggnttaacgccggaagaacggnttttaaattaacccttttccaacgaaccccnccaattttgcccncaacccccaacccaaacnggtgntgggtt

SEQ ID NO: 7644 - DNA, 741 bp, Tricoderma reesei
  misc_feature (1)...(741): n = A,T,C or G
nctcgggnccgatntcggtnacgangctctatcttaccagntacctcctgtcctctctccttgaagngcatcacagaaggctcaacctctttattataccactataataccccaccttggcccttcgcccactttctgctctcggcctctgcctctcttgactcaccaccacaaacacacaacttaacaaccgcctctgttgtacaccaacaagcaagcaacatttcaactcggaaccttttactcctgctcctctcttttgcacaatcaaattaccgntacaatggccctcgacatgtggacccacgagttctgcctcgcctgcgaccgacaagtccaggtcgacggcgacgcctactgctccgaagcgtgcagaatggccgacttcgaaaagaccccctctacacccagctcgcagccaagctcgcccggcttctctcagtctgctacgcctcctcaggcagcctntcagccgacctgcgcccaccaagttctacctgcctccgcctacgacttaatcgagcccagccctacgggtaacacctnggacgtctgcttccttcagcggctacacctccgacatgtcgcccgcgtcgacacaccggggcctgacgcctngagctcaacaagcagccttttgnttntatgcaaaagcgggtcttcaaccggccgagtcaagcangttgtaaancaggcacgcaaggagctgcnagcatacnccggtttctttgacaaggtaaa

SEQ ID NO: 7645 - DNA, 824 bp, Tricoderma reesei
  misc_feature (1)...(824): n = A,T,C or G
gcccagccccacttccagaacaccatgctggcgctggaagccggcaagaacgtcttgtgcgaaaaggctttcaccgtgacggccgcgcaggcccgaaagctggttgagacggccaaggccaagaagctcttcctgatgggaagctgtgtgggacacggtcttttccgcttgntatcaaagattcgaagaactcattggccgnccggcgaagattggcactggctttcgaacaaatcgcccgacttggtccatcaaccgcaaactcaaagcaagggtcaagcccttgaaattcgcagactcacatcgaatggtcaacccggacctngcaggcggtgccaccttggatctcggagtctatcccttgacctgggtgttccanaccctgtattatttgcaaccggaggaagacaaggaggcttccaccgtggntgcttccagcaacaaagtaccaccactggcgcagacganaatacccgccattatctgcagnttccctngccacaacaagcattggaattncttcgacgacgatgaaggcggacaccgaccccgagaangacacnattccngcggtccgaatttaaaggatccaagggagaaaattcaagtctttttttccganctaacgancgntttaagtacaaaggnggngaaaanaaacggggaagggcaaacnggtgactggcccattccccggaaaccccgcgcccaagggnttnggggcccaggaatgtttttgggaggcggacnaaatgtgctntaatgncttntcgatgggcaanttggaaaantggccacctttccttggaaaggaaaccattggc

SEQ ID NO: 7646 - DNA, 1510 bp, Tricoderma reesei
  misc_feature (1)...(1510): n = A,T,C or G
cattcttagaagctgnccgantcggcacgatgtgccgcgacgttcctttatctgccgtccacagacattcattcattttttgcaccaaatagactcatcgctcctttcagctgctttttgctcgtcgcgcacttacgctctcttttgcaccacttcaatcttcaatacaaaccactgcaatcatgaagctgtctacgaccatcgcgactggcgctgcccttgtggccggtgtttctgctggacagaacaactacctcggcttcaactcgggcaacaccctccccgacgaagtccgccaangttcgagaaggacttccttgccgagttctccacggtcccagaaagctctgtcnggcgccncccgggcaaccttctaaacgcccgntccggttctctacaaccaaacaatcccagggccctaacttccaanggggacactttcctattcggnagggccctttcttccgggcccgnccattcaangnacccaangaacngttaccaatttcctttccttcggggggtntgggggcccttncggggcccacctgngantaaacnatctggaaacaaattgaagacnttgggttgnccctttgagacgccccccgtcaaacaagtacggnaggaccttgaccggacctgatcattggtgtctccatcggcagcgaggatctgtacccgtgactcgcagactgggtcgaaccaacaaggccggtgtaggcaacggccccaaggaggtcctcggcttcatcaaccactacaagaaagacctttgccaacaattggctctggccaatgtccccatcggccacgtcgacacctgggatgcctgggtcaacggcaccaacaagcccgtcctcgacgccgtcgactggatcggtgttgacgagtaccccttctacgagacaggcaagggcaacgacattagcaacgccggcaagctcttcgacacggttttcgaaaaccacgcttgggcgctgccaatggcaagcccgtctggggtgaccggaaaaccggctggcccctgaccggcccgactgggacaaggccaagcccaccgtcaagaacgcccaaaaatactggcaggacattggcttgcaagaagcttcttcaacaaagtaccccaccttcttggtacaacctgcgtgacttccaacccggccaaccaggtcaagttcgggatcaagccanagcctctctttcacccctttcgttcgaccttgacctgncccaaggaggagaccaccaccttccggggcaaacccaccgcaccacccttgttaagggttttggacanccgaacttgtnaagtttggnttcnagggaccggttacgccggangntcaagtcaacaacaagcgatgtttccaccacttaataaggccttgcggggcaatacnacggggccggngccngaacaagggttccgggnttgcctttgccgggggggcatggttgccggtttctggccctttttttaaaatgaaggacaatttttgnaataacc

SEQ ID NO: 7647 - DNA, 475 bp, Tricoderma reesei
  misc_feature (1)...(475): n = A,T,C or G
tgtctctgttgaacagaacaccaccatcgcacaacaccaaaggcaccaccgctccttcagcatccagctccaaccaccagcaaccatgaagtccgtcgccgtcgcctctgctctgctcgtcgcagctgctgccgcccagcctcaccacggncaccacgcccgcttccacgcccacaagcacgcgggccgcgatgttgtcgtcaccgagaccgagtggcacaccgacaccgtntacgtgaccgaggtggtcgattccacctacacctactgggtccaggacgggaagacgtctttgccgntcncggcgaggccacgggntttgcaantntttccgcttgccggggagttttttnnagcccactccancgttgagnnggcatttcacnagcaggttcttntcttcccngagacaacattggggcgcagttngtttttacgccccgcgcgcttntaaaacacttctttgaggttncgt

SEQ ID NO: 7648 - DNA, 495 bp, Tricoderma reesei
  misc_feature (1)...(495): n = A,T,C or G
tcgtcattgccattgtcattggcgtggctgttggcgtcacgcaggggaagaagagttcatatcccgactactcacagttgacatataccctcaaggatacattccagggagaaaccttctttgacaacttcaactactttgagggctgggatcctgccgggggattcgttcactacgttccgcagcctcgagcccaacagctgaacctcacttttgcatcccaagatgccgccgtnctcagggtcgacacatccgtcggccccgggcaggaaccccgacgcctccacgggcccgcttctccgtgcgcgtcgatagtccaagaaagacgtacaacgacgggcttctttcatattcgacgttccgtcacacccccttacaggtggcggcancctggccnggnccttctgggcttgaccggacccgttccaactggcccctgacnaccgggtaagatccgaccttnattggaagggcnaccaacaagggccggactaa

SEQ ID NO: 7649 - DNA, 500 bp, Tricoderma reesei
  misc_feature (1)...(500): n = A,T,C or G
tcaacaagaaggacatggtcgagttcctcaagcaggtcgccgagcccaaccccgacccggccccctcaaacggcaagtccggcaagaaggcctccaccaaggacaaggccagcagcaaggaggccccccaaaaggccgncgccgccgacgagtcttcgtccgccgcatcctccgagacctcaacggccgcgcgccggagtcgaccctcatcgacatccccgccctgacttccaaangcagagctcgaggagcactgtctccaaccaaagtcccaaaacctgcgtnctcgctttgtgcccgcgtccgcttcggagatgcgcaacaagatcctttctgccgtctccagctgcacaccaagtacgttcacngaaagcgccacttcccttcttntttgtcgacagcgacgtcgaaggnttntgccgccttaaggaaccctcggcttttcgggcaagattgagctcgttggccttaacgcccgccgggggtggtggaggcgatac

SEQ ID NO: 7650 - DNA, 923 bp, Tricoderma reesei
  misc_feature (1)...(923): n = A,T,C or G
gcaacggaggccggagtgaactcggagagggcaaactcagtcagcgggtgatgggctggcagcggcgcgttccccggtctgacggccgggacactgtgcatgcccgactggcgagcagcgtccacctcgttgaggttgtcgctcaggaaagaatcccagcgtgccgggcttgacgtcgggatagtgaagaacaggatagtgggtgtagctagccaccgtcgggtcttgggcccccgcattgacggtgtcgaaccagtcagaagatgaaagaccttatgtcggcgggttgggccggtccgtgtgaacaaaagaaaaactttctgggcccgggacccgatcccggacgantatatcatgatctttctggcccggccgcatgaagcattggtgatgaaagggtggcacgttagggaaagagtggaaccttgaggacgccggactcgtatccctttcttcaanaggtagccctggaaccgcctttangtaccggcgccttgacgtctcgggccancaagtnccgaacgtganccttnaaaggcnccgcggtcgttgcngtacttcttaaggaaagcgtttgcngtactcgcaaaacttgactcgtccactgnttcggncaagaaacccggcanggacttgganggcattaagggnaacttgggantttggaccggaacaaggtcctttcgaaggtanccacaacgggttgggacngngaccaaaagaaccaaaagacnaccaatgtgcccggttaaaaaaaagcaaaccaantgccagtccnagcactacttggtgcaaagacctctnttangtctacttgnggggggcccaaaagtngggtttgaacaaggacctagccctnntttttgggggnaaaaaagggngggcttggtaatctnggatttgggcaaacttnattggntcct

SEQ ID NO: 7651 - DNA, 874 bp, Tricoderma reesei
  misc_feature (1)...(874): n = A,T,C or G
cggcacgaggccgccgccgctgccatcgtttccgaggctttgtgaggacttggttgacactactcatctttaactacgtcacagccaccagcaacctccgacatgccgcctctattgctccgacctcatgccagcctctcccacgccgaagctctgcaggtagctcagcaagcccccgagttcctgcggaagaatcctgcgtcatactcagcatcgccgctgttctcgctattttcacccccagaaaactccaagacatggacaatatacgaaaacctcttgctcgcctgtctacggactggtgactatacaacggcgcaccaatgcctcgaaagattggtgattaggttcggggggaacgacgagcgcattcaagccctcaaggcctggtgaaggaagccgaggcaacagacaacaagcgagctggaaaangtgctgaaggaataccangcaatcttgggccaatgatacacaaacgtgccaatctcaaagangagaatagcgcttcttcgtgcaatgggaaggacaagttgaagcgagcgaaancctggtgcagttccttcgactttgcgaccacngatgccgaggnctggattgagctctcanacttggatntgtccanggtctgtacgcncagccatatacctcaagaanagncctttgtatcgcgccaangcgtggaatntccatgcccgctaggcgangagctntttattggttgcanagtttgcaaccatggaaaccctnaaggcgtattttgnanaaagcttgaacgtttntgccnaacanttganctttgggangaatnttttccgggttcttccggctggaaccaggtaccnanaaacttcttcgncaaggatttaaggcaaaa

SEQ ID NO: 7652 - DNA, 890 bp, Tricoderma reesei
  misc_feature (1)...(890): n = A,T,C or G
tatccaactgaagtctacactcgttcaaacttccaaacttcaacctctcaaccccaaccaaacaaccaaaccaccacccccaaaacaaaccaccaaaaaccatcaaaatgcgtgccgccgctgttgtcgctatcttcgctgcctccgccatggcccagaccggcggctctgcctctcccaccaacggcaccagcgtcacccacaccggtgctcccaccaccgcccctaccagcggtgccaactccctgtcccagaacatcctcctcggtgtcggtgctgctgccgtcctcgctgccagcctctaagcaacttcaacttttttttattcgaaacctttctctctcttccctgataatttgaggggctttcggggatgtctagctcaagtttgctaggcttcctgtgaagctccttaccgacttcttggggaggggaccggaggaaaagaatatatcatggatctggacgggatggggatggagggggaaaagaaggtcaatttagtttgccggcattagaagtctttgggaggaagagagaagagcggtacttttttttcgtgctttattacgaccacagcaaatgggataaaggatatacctatcgcttcttttcttcgagtcaatcaaacacttccaacccagatctctcgtctttcccttcccngancccggactgtnccgggcccgcaaaaagcaaaccatgaaccgggggttnctttttttttcgacaactcaattataccaaacggactggctttcggcgggaaangaaaagggatttggcgccgncaaacttattttgggggcatttttggctttgctttttttttcncgaacctttttcttttacctttctttttnatttttttggctttttgaattttgcat

SEQ ID NO: 7653 - DNA, 812 bp, Tricoderma reesei
  misc_feature (1)...(812): n = A,T,C or G
ctacgagctcgcctttcccgaatccagcgtcgacctcgctaccggatggccgaacccatttcctgttctcctccagatcatccacctctacggtcaagtgtgcgatgtgctgaacaatctccacgacgcccaagaccttacccaggacaagtgggatcagctatccgagatggagcatcgactcacgagaatgtacaagcactgggacccgcggnttcagttcaacgtcaacaactttaagacgtacctcggcatgggccagggcaccaactttatnctcctccacttttggntccacgcgctcttcatcatattgcatcaaccgactcttcttacccccttttgcgaactgnggagcgagctccagctgctctnggacagccgtgagctgagcatgaacagcgcaaagaccatctgcgacattttgncctttgccgactcgatagatccgacgagttttattggcaacccattcacgaatcagcccatttatatcgcggcatgcgcatttctcatggaatcgagcgccaacaatgcatctgagggctcgtccagggagggctcgcttccacttaagcgagtcgttcangcaacagacgaagcactttaacaagcagtcttcggcattcgcttntcgcgtcggncgccaaccagaattaccaagcgatgctacaacttcctgcagaaantccaggcgtactggggcggagtagggctatatctnaccgngcttggacaaaagtcaaaaggnaagggggactgngagacgtataccggggaggagtatganaagccccaagttgccccttctt

SEQ ID NO: 7654 - DNA, 505 bp, Tricoderma reesei
  misc_feature (1)...(505): n = A,T,C or G
nttcttaacgcccggcaaacccccgaacccgaaattcaacctggtgggcattgnggcgancaaagngggcacccgggcccgtaatntggcctgggacgaggactatacacaagcttgangangacaacgacccgacttgcttgcttcaaaaagaagaagaagaagcccangaaaaggccgcnacacaaaagtatngctgcaanggcaacgaccgacttttgggccccggtggcgacaangacaaggcaattgccgaattcnaagcttattcgaaaagacggcattctggcaccaagatcgaactgtgctggccataatacgcatgggggctnttttacngngacaagcccctngtcaagaacaagtcgagcggccaagacctcgtcgagtcggcggcgattggaccgacggaaccgcttaaggctacnaggcctgnaccttattaccgtccgngcctacaaaaccgcgggcccgttgttgttgaattccttttgacnttaccagt

SEQ ID NO: 7655 - DNA, 683 bp, Tricoderma reesei
  misc_feature (1)...(683): n = A,T,C or G
nctcgnccgantcggcacgangcggaccaggtactccagcaaagcctccaaggccgatgcccagaaggaaaaggccgcccaggcacctcactggctgagcaacgaggcggacgacaagcaaaaggagattgacaaccgagagtttgccaagcagctctccaaggccaaggagggtgccaagttcaacaccaagaacgacggccccaagcagcgcgagaagaccgtcaagcagtccaaggccaacaaggccaaggctgcccccgcccctgaggctgttccctctgccccgtcgtccaacggngctgatgccgacgatgacgagtctcccgttgtcctgtcccccgagacccgccccgtcgacgttggcggtgtcagcgacatgctcgagccagccccnngcggcccttcgttctgcgtntgactgataccgagtncaagaaggacaaagaagcccaaggccgcaagaaccccgaaccggcttganaccaagangcaganacagancangaagaaggctgaggctgntaaangccgtctngcgangaagggcccgaaaaagagcgcaagatcctttgaggaagaagcanccgacgcactggttncattgtcgaaggcccgngccgncaagggatggctctgantttnttggccgccgttcaacggcaacaagtntgcttggaacg

SEQ ID NO: 7656 - DNA, 758 bp, Tricoderma reesei
  misc_feature (1)...(758): n = A,T,C or G
gtgctctcattaccgtcttcgtcctctggcgatggctgggccatggtggactgggggcatcccggccacgagctcttccagcctacgcccagtgccgccatcttcaacccctcccagacactgcacttgaggaccaactcggattcctccgacggccgcaactcggtcgaaatcggtagctttgaggaagttgccccctttccctattcgcccttctcaccagactctgatggccaagccgagaaccacaacaacggccaccggaactgctactcggccgatggccatcatcaccaccatgatcacagccatagccatggtcatacccatggccacagccatagtcacagtcacagtcacagccacgttcacagtcccatcgcggtgactgccccagtctccctcaaggggcgagtcgtctgcccgtcacagccctggcagcggagcgggctcggtatcccccttttcgtccaagcaccacctcaaggaggagtgccngaaagtgctggcattcgcaagancccgattgcaangcaccccaaaaccgtcgtcaggcgncgtctcaatggaaaagaaggatggatctgtcgagaagaaagtgggccgtaaaagggccctnttttgcagacagcgnaaagcaagccagcgagataagaaaagttgcgtgcttgctgcnatgaaattcttaaaagacttgnatagggnagcctgcctggatgcaancgtttacnccgctttgnaggtcctggaccggatcg

SEQ ID NO: 7657 - DNA, 675 bp, Tricoderma reesei
  misc_feature (1)...(675): n = A,T,C or G
taaatggcatctttcaagacagcttcctctctccagccctgtctccgcctcccttacaacaatctcaacaacaagctgaagccggcctctaccaactgattatcctccacctcacattcatcatttttttttggaacaatgagctcctccgccgactcccttcctccccacaagcccgccaaggaagcaaggaaactcgcatgccgcctctgccagaagcgcaaaaagaagtgcaaccggaaaagcccatgctccatgtgcatcaagctcaaggtcgtttgtcagccaagcgcacccgccgttccgcggaagaggaggcagtcgacaaangacctnttcgcccgctggcctggtgcgaggagcagctgcggcggaatctcgagtgtcngcagtgtctcgagtgcaaaaattcgttctcaaagtcatctacagagagctcgacngcggagattgcaaagangctcttctgagatcaagtctgatccgagcatatcctctgcgccgattgcttcttcttntttttctccccttcatcttattcacctccccattcactactatcaccaccatcttcttcttttgacacaatatccgcttaaanaaaatgatgatngaacatgctgtacttaataatattaataaaaagccaaccttttgtatgaaaagacntccctt

SEQ ID NO: 7658 - DNA, 904 bp, Tricoderma reesei
  misc_feature (1)...(904): n = A,T,C or G
cgcatgtcgaggagaggcgctgcagcctgctgttccactacaacaacgcagaggactacgagtcggcgtcccgccaggcctctgactgcgccagccacgtcaacgatgcctgcgagtcgctgcgggtgcacgccgtagcaacggacggagccattgtggttgagcctctggactggaccaagtgcacggcggctcagcgagtgtttgagcagctgggagagcacatgaagtcggatgagacacacaagcagcccgtcgactttttgatggttgtcggcgacggaccgagaagacgaaaaggtgtttagatgggcaaacaacctgggcgagcagaaccagatcaagaatgtcattactgtgagccttggcagccgaagcaccgaggcggcggccactttgacccagggcgtgagcggtgtcttgaactgcctttaagcgtctggcatcggtgtcgtagggaagcatccttgcctcagtctttgcctagtttccccaccactctcttttccattcgcagntgttttacttgacactttttcctcctgtttctcgtcattgnaaggcgtcttttggtatatgaaaaaggaggcgtccnggtttcatttggagtctgaattatatatcttgaacanggccgcanancatggtctacaccnatggatgggccttttatagcacgagtcccctttttttcttttgcntnccgtccgaaatggancaaccaagttttacgtttgaaaggaggngaaaaaaaaagtcattgntcattacaacttgnccagcatgtttntgttcaagctttgatattcngcttggttctacatgcatttntagttggccgttttggttgntntttgtgctttnatgggattgggcgncggattaaanacccattggccggnct

SEQ ID NO: 7659 - DNA, 391 bp, Tricoderma reesei
  misc_feature (1)...(391): n = A,T,C or G
nccgctgncgantcgacgaggtactacggtcaccatcaccaccaccaccctccaccaccaccaccaccgcctacaacaacaacaacagccatcatgaaggtcctcaccaaggaagaagaagccgnccactaccgcgccgtcntcaagggcggcctngtcggnggcaccgtcggtctcgccatcggcgtcgcgggcgtctactacggntccaagcggtaccccagcttccgcagcctgacgctgcccttncggacgttcctcgtnaccttncaccagcacntttggcgccatcntacaggccgaccgcgccgggcgtcgccttccagaaagaagcaanggacccatgtccaaagttccggngacgcnctcccagcgcgcccaaggaggtgat

SEQ ID NO: 7660 - DNA, 843 bp, Tricoderma reesei
  misc_feature (1)...(843): n = A,T,C or G
ntctcattattnatttttttccctttattccccatttctttttttcctttgtcataattatccccaattgtttctttcgtcaccctcttccgtcgtcgtctccggttacgaaggctcgtcaaccacacccccaagaggcacacacggcctttttcggtggcactgcggttacaagtacttgttgatccaagtggtcttgcactactttgccgaattgtgcaacctgaccctttcggcccccagcttttgctcctctggttgaccaaggaaaaaaaagccgagccagacctgttcagtcggatgcgctcttaggcaacattgacctacattgcctcgcccatcatgcagcaagtggcaagtcggcccgtgccggactacgtctactccaactccccccacccgtccaacgacatgcataaccatccttacccngccgatatggctcgccgcaacgaagctcgtatggatttcccctacggcctcagctaacatggctgccagcaagcaacaccacccaagcgccgtcagccgccatgaacgtatcgcagcagtcaccaaacggccttcttcgcagcagcagacgcccgaccaagcccgccggccanccgccaagtgcccgttnacggaagcgcccgggccanaacgcgggncttacccgcacgggcggcgttcacttncgngggcccggccaagggtaacactgggcccacgccggccggtcccaggtggtcttctgccaacccaggtgccggaccgaggaccnaacttcaacgncggccggttggggcctccgccanaaaanccgacgaataccccttggattcccaagagganttcccttaa

SEQ ID NO: 7661 - DNA, 536 bp, Tricoderma reesei
  misc_feature (1)...(536): n = A,T,C or G
gctctcgcaacgctcattgactccgtcacgaaataccacccctcaccaatccaagcagaagagctcaagaacgccgacaatgaactctgcaaaggcctggagcaagtcgagatccatcagaggaaccacctcaaaatccaacagctccgccaaatgtccaactccctcgacgcccagatccgcgaaacgctcacctccctcgcaacaacgcgcaaggacctcgtcaccacacaagtcaccacctacccttccgaaccaaactacccgatcttatacgaagaagctgctccggnttcgcccgncgcatcaagcaagacctttnatggcnggcccggncggncatccttnaacgcncatgggcggncgncggtccggcggggacgaaattaaagaacttnttaagacgccnggttncttgaattcttaagaccccagatngggccatgaacgcccggtcgggggcaanacttccgnaatncccattgccagaggttcccggtttcttacccaatngggggtaagccngnaacaaacaa

SEQ ID NO: 7662 - DNA, 861 bp, Tricoderma reesei
  misc_feature (1)...(861): n = A,T,C or G
cggcgggacgcaattgactcttccccccaagccatgtctcttcaatcctgccgccccagcgtcgctcgctgccgccacgcctcccgcatcctcacctcctgcgcccgcgccttcgctaccgagtcctcgccctcatcctcaacaccagaatccttcaaggtccccgcgggaacaacaacagcagcagcaacaacaacaacaaccacagagccgacgacaaactacagcagtgcgacgacgaagccgaagccgcgatggagccatacgcctgagggcatgaaggcgccgctgcagcttgactttgcaaagagcccgcgcaacaaggtctgggccgtcaacaacgaccccgcgcgactcgacgatgtgtacaaccgcttctggggccgggaggcagcaagatgcttccggaggagctcaagtggctggccgtgacgcacaagagctttgaccagggccggagagggttcaatgaccgattggactgnttgggccggttgacatggtgatggaggcgacaaaggaaatcgtcagcaaggagcccctcgcgggctnaatactggccgaccagttcgacagacagccgntnaacgacgcgcaagttgttggccgnggacaaccttcaacgtcatggggcccgcgcgacgtcattggcaaggacaagctttaccaagttggncaacaaggtgggattgttggaagtggtgcggtggaagccccnattgccaaacggttgagtcttnggcgtggaagtgtcttnagttcggcattatggcattgncggngccttaccttgaaatggaactgttgggcgnccaagtggtgaggaaaagatctggccaggttccaaggacattgaggtng

SEQ ID NO: 7663 - DNA, 587 bp, Tricoderma reesei
  misc_feature (1)...(587): n = A,T,C or G
ggccaagccaacattgactacctgctgaagctcagcgaggagtacaagagcagcgagctggaagtctctgctgcccgctcctccgccggcgactttgtccgcgagcgccgcgaagaagacatcatccgtgaccgccgagaggaggacatcatccgcgagcggcgagaggagctcatcatccaccacgagacgcccgcccctcctcctcctccgccgcagccgcagccccagccgcagccccagaccatcgtcgtcgcggcgcccgctccgcctccgccgtcatcatcgaggcggccccgcgcgacgccgtcgagctcgtcgacaagaccgtgtaccgcgaccgngagcgctcgcgatcgtccagcagccgcagccgcagccgcagccgcaccggtcgcactcgcggnatcacacccatcgcactaccgccgaagtcattaccgcacagccactcgcggacaagaagcacggnagcggcgccgcctngggctcggctcagcggcagcagcaagcgactacgcgctcgtcgagcaagcgccaccggtcgcgatnccgcagcggnaaggagatccgcgccgagatccgcg

SEQ ID NO: 7664 - DNA, 539 bp, Tricoderma reesei
  misc_feature (1)...(539): n = A,T,C or G
tttgcctcctcttgagctcgccattcgctctcgcatcgtcttcgcttgctctcgttcaacgacaacaacagcagcatataccacaccgaaaaccctcacaatgaaggcctccgtcctctctctcctcctcgccggcctggtcgccgcccaggactttaccggccagcccgaatgcgctatcccctgtctcaaggacgccatccncaaggccggctgcgccctcacagacaccgcctgcgcctgcaaagcccgacgtccaggctaagctcctcggcctcgtcggaccntgcctcctcagcaagtgcagcccagcgacctcgcaaanggctcaggccggccgctgccgacgcttgcaagaaanaacgcccggngggttcgaaccganacgtttttttgccgccccgggtnacnggccaacgggncaccgggttacnggagccttgnattnccgaaaaccaacccacggttttggccggccggaagaaccaacncacccggagggntgggcccacnccacccannttggaccgcccggggga

SEQ ID NO: 7665 - DNA, 521 bp, Tricoderma reesei
cccaactgtctttttctaaaaacagccggtgtcctgtttttattgatcttcagttgccgcctcaacaaagagaagccgagtgatataaccgcaacagagacctagcttctttccactcatcaatcagtcccttgtttcccctccccggtctatcgaagaggcatctcaactggaacaatcacacacacccatacaaatacaaacacatacaacgaaagccatggctagccgtggagatcgctgggagcgggatcgcctcagtggcgaccgcgagagaggccgcttcgtcgaggaggagcgcgagcgggagcgcgatcgggtcttcatgagcggcggccgcagccaccgcgaccactcggacgagcgcttcgaccgcaagtacggccggacgtcctacgaggacgacattgtccgcgaccggcgcttctacgaggacgaccgcttcgaccgctcgaccgccggtccgacgtccgcggcgactcgtacgaccgccgcgtcgtcatggaaaaggagcgcgaccg

SEQ ID NO: 7666 - DNA, 860 bp, Tricoderma reesei
  misc_feature (1)...(860): n = A,T,C or G
agcgggccgagccacaactacgacatgtaccgccagcagacgggcttcgtgcctggcgccatcgccaatacgatggccgtcaacgagtcgggcaacctcggataccaagatttcggaagcctcgacttccttaccaacgaaagcgaaatgttcgacttcaacgtgtcgccctcgcagagcaccatgggaccctcggaggcgctcgactttgcgtcgccgcccaacacccagctctttgcgaccatcaaccccagcaacattgagcagggctcatccaacgtctctccctcctccacgagccaaacgagcaccgtcggccgtctgtggcccggcgcacactcccangctgccatggcgaaggcccatgcccagcagaggcagcaacagcacatgatgcagcagcagcaggtgcagcgccagcccggtcagcccgccagcagaagcctcgcgcaaaggtgccgccaaagacggaccccattgtcgagcagaagatcaagcagctgcttcagaagatgcgggcccagcctgcgtntncgccttncgacaagcttcacgccctcgggccacctggncaagggcaagaaggatgangaagaaatggacgaggacgagcgcctctggtagtgaggagggnaagaagntnacaagcaaggagcgcaaacaggtttgcaacaaggtttaanccgagcttttcgntnaagaagaaaagaatacntacccangttggagccgaagtnttcagcaaagtacaanaaaaaatgactgggngcgcaaaaccgggnctttcttnagganaacangcgctggttgggcttgaatcgatgntttttgngtttctttattttcaantttctgggnaa

SEQ ID NO: 7667 - DNA, 670 bp, Tricoderma reesei
  misc_feature (1)...(670): n = A,T,C or G
cccgagcccgacctggactatgagcacgccgactatggggagaatcccgcgtacggcgcctcggcggagaggcacaggatggcgccgccggagcagcagcagcgcgatggcagctacgcggttggcgccgagacggccgagggcacgtcgggatggggatcgcgaatgagcgccttttcgtcgaacccgcagaccttcctcgactcgactgggaagacggtcgccgctggcgttgctgccgccggggctgcggtcggcaaggcgctggcctcgatccgcgaagaagacaggccggagcccgaaacgaacccttggtccgagaacagagaggtgcgcagggaaaagggaccggcgcctgttcagaagaagcgcaagacggtcgccattgcatatctgccgactccagttcaccgacgacgacgacgacattactcatgagcatgcctccatcttgaaccacatccccggcacaatgaccttgtctgcattaagcttttcgtgctcatctacgcacctagctttgaaagacacgggtgaagccgntccantaatcgcccgcttcttcngntagctcatcattctctacgttggattgatcaagctcaaactcccganggcaagagcccagtacttggcgcgtcggctgaaaacaccntggttcaatggccgt

SEQ ID NO: 7668 - DNA, 741 bp, Tricoderma reesei
  misc_feature (1)...(741): n = A,T,C or G
atactntggctcatcacgcttcctctcgtttcgtttcgtattgatacgctctctcttctcttgaattccccaggcacctcttgttatcaatcatcagtgcgcattagagacagcccgcccaagatgaagtacaccgtccttgctgccactctggctgccagcgttgctgccacgccttctcaccaccaccatcacgcgcaccgccatgcgaagaagcacgctgccgcagggtcgagaagcgcgctccggatgttgtcaccgaggtcgtcgtcggagctaccgcaccgtcttcgagctcgacggcaagattgtcgatgccgcgacggccaaggccggtctggccgagggcgagtacatcatcgtcggagagaccaccccgaccttcgtcccgccgcctcctcctccgctgcgacctcgagcgccgcccccctgagggcccagttcgtcgaggagcccatctcgtcggcagcggttncaccaccaccttcgcccgccgncgcgncacgacacggccaggcacgacagctntgcgccccttcccccaagacttgaagcctgcccagtcgagcccgtcctntggcgctccgggctggacgccgactttcccagcggcaagatttcgtgcaaaacctttcctttcgaagtaccggggttgnggcctttgactggctgggcacttgggggntgggnccggcttcaagttggngcctaactatnagcccggatgcgcaaaacattaag

SEQ ID NO: 7669 - DNA, 135 bp, Tricoderma reesei
  misc_feature (1)...(135): n = A,T,C or G
tggcctcgacagcgaccaagcangaccccgcccgtcttttgtcgggaccacgcaaggtcgtcgagaccagctatccgctcatcgacaacgatccccacttcaagcgggttatccgatatgcgaaggacgtcaaga

SEQ ID NO: 7670 - DNA, 903 bp, Tricoderma reesei
  misc_feature (1)...(903): n = A,T,C or G
caacgngttgcaataccccgtaccatcacaagcatatcctcttcgatcacgtaccctacaataccatacaatcacaatcatcaccatggctgtcaaggtctttatgacgggcgttactggctacatcggaggcacggcctttgacaaaatctacagagctcaccccgacaatgagtacacgctcctcgtccgcaacgaggcccgagccgagcctgtaaaggccaagtaccccaaagtcaagtttgtctacgggtctcttgatgacgtcgacgtcatcgagcaagctgctgccgaagcagacgttgtcatccacaccgcagaatcagcccgaccatgcccccagtgcctccgncatcgccaagggcctggaaaagggccacacgcccgagaagcccggatactggattcacctctccggcacaggcatcctgacctggtacgacgtcgtcaacggcagagagggcgaagcctccctgccggaccagaaataccacgacatcgacgacatcgaccgcatctcaacctcgacaccgagccccccacagagacgtcgacaagattgtccaggctgccgtttccgactcggtcaagcctgccatcatctgncccccgctcatttcggccagggcttgggtcccggcaaccagcagacgatccagatccgacccttcgtcgagatgaccttgcgggaaggntttcgcgccgntcgtnggccangggcagaaccgaatgggattacctacacgttgacgatgttggcgaaatggttcttcaagctgttcgagggcagccaggaccccgaaaagaanaacaaaccccggagatcttttgggccgccncgggttctttttngggcccaanggnggtcttnactttcaanaanaattgnaaaagngggttgct

SEQ ID NO: 7671 - DNA, 797 bp, Tricoderma reesei
  misc_feature (1)...(797): n = A,T,C or G
gcaggccgagtactttgtgccctttaccgctggtcagattgcgcgcgttggtggcctcgaggccaaggatcgcaaggacgacacgattgggccttttgcggttgacctggtggagtacgatggctcaaacgacgtccaatactaccgcatcactctcccaacacctctcaaggccggcggccagtaccccctcgccatctcatggtactacctcgactcgtatcgccctcttccggnctcgattgctcaggacgaacaagcaatttctcgttacgacttttttctctacgcccatcgcttacccgaccttgaacaaaaaaccgagggtcaagttcttcgacggtcaacatcccagactacaccacgactacccggccctggaggcaaggaagtatnccgagaagcatggcaagtaaagatgcttgtacggacccttttgacgaagcagnccggccggcgcctacttccncgccaggtcaaggttcgaagttcaccaaagcccgtcatccacgttgagacgcttgagagagacattgaaagtcagccactgggggcggcaacgttgcgtttgaggagagatacaccttgcttcatcggggtgccaacctctntttcctntttaaccgcgtcaagtggctcaatctcagttcttncagcctgctacatggcattgaaggagctcaagttccctntcagaattggcagcgttgacccctacttcatcgacaccattggcaacgtgtcgacctntcggttaagaacaannaagccaaaaggcattctggagctgaaccccc

SEQ ID NO: 7672 - DNA, 749 bp, Tricoderma reesei
  misc_feature (1)...(749): n = A,T,C or G
gagcgacaacgatgcgactcgaggattcgtcaactcttattcgacactcaacaccaacgcgccgatccgaacaccacgagcgccggcgcaggaagaccacattgccaatgagatccgcaatatcagagccctcaacgagacgcagtctgcattgctgggtggcgagaaacacttcttttttaccaggggtgctgggcttcacaaggattcgaaaggcattggcgccccggaaaacaggtcattggccacttccgaacccttttgggccactcccttaagaagccgggcgggcgtcaatggtggcttgttcttggacaagacgcccattgcgcaccccccgagacacctttgcccctcaaccaggaaagaatggggcgacgggcgacaggagccactccccgggacgtgaganttgcggcaaatggccatgcggaaccactgcaggctggactggctgcgctgnccaagcccaaggatacagagtgggagttttgagatacccgaggaccaggtgccgactgcggcaaagcgaaaaagccatggaggaggacgcccgtcnagcgggacangcgaaagccgccagagacgaaaagcccnaggaggcgcttgaacggcggcgacagacccaggtgatacaagcgaggactttcgcgaccggtggttgtcgacctaacggactttnttgganaaggccaaagaggattgacgacccccnttgnggcgcttatttgccgangaaggttgttggt

SEQ ID NO: 7673 - DNA, 938 bp, Tricoderma reesei
  misc_feature (1)...(938): n = A,T,C or G
nntttaagaggtcgccgagctgctacccaattccagacccacgagtccgaccgcgcccaacgagacacggacattgccgtcgagacgctggctatgatgctcgagatcagcaccgagagggaggtccaggcatttgtgcaaaaggtgacggccggcaaggcccagctgccgcccaggacggccaccaggcgctcggccgtgtccgcaaaactcgggcaagcgttccgtcgacgcccgaatccnacttaagccgccccccggacgaacaatgtgagcaagcacaattcgttcccaaacaccgagggaaaagccggaattctaagttgcgaagggttaggaaccatgtttggcggtcgacggcgccagaagcgttcatgctgggcttcggctccctctntccccagaaggcgcanggagctacctttgggcgactcggcagcaagccacggtcgcggcgcctcgccaatgggatcttncagcaacctccacgagtccaaccggctgtctatcctccccgagacgcccgacgcagctcgcaggccgaagtcatcgtcggacgccatgcaccgggacagggaacgcgagggcgaactgtcgacgaacggggacggaaccacgaatggccttggagctggcgagagtctcttggatagccgagtgccagcgatgccacccttcgagctccgtcaatggcaacctnaacatcgaacaagagcagcatnagacacccgaacccgccggtcccggccgatgcgccgccatntnaacaganccagcaggancccgnccgtcagccaacattcaaggacnacaaggntttacgataccggcgcccatgaacatccatntnggaagccanaaggagnttgcaacnaaaanaatgaccagtttttaactnaacattcaaaacaagcccnttgaggaaaagacccnaggcg

SEQ ID NO: 7674 - DNA, 115 bp, Tricoderma reesei
  misc_feature (1)...(115): n = A,T,C or G
naggctccacggtcntggaccncnactggcgctggactnanggctacagaacactantncataactgatanganggcaacactaggagctcctcctatnncctgacaacgagaca

SEQ ID NO: 7675 - DNA, 831 bp, Tricoderma reesei
  misc_feature (1)...(831): n = A,T,C or G
tccttgactcgcccgtgtccagtagaccctttggcatcacgacggcgccgcccacgacgacgctgcccatgcgcccggccatggaccaccaacagcagcagcagcagcagcagacgaaccacccgagcggcatggacctccccagggcgacgcccgtctcgcgctccgccgagttcaagcccagcgacttcccgccaaagcccaacgactacgcacccagggccgccgtcgccagcgactatcccaaggcgcacgacttcccgccgcggccgtacgagtacccggtccaggtcgcgcggccgatgcagcagctgcagtcgccgtacaagcccgcggtgccgcagctgggcctggaggacgtcaaggccagctgccaagcgcaacctcaagcacctnatgtacctgcagaaccagcggcgcgcctttggctactcgtcgcaggccgtcgatctggagtggcagattcgcggcagacgggcgtcttgatcggcgagctgcggacgctgcaggacggggtccnccggatggtcaaggacgcaaagaaccaccgctggcgacgatggttgtttggaggcattctcgcaactttatnccttgccgtgcgcaagctgtttcgncgcggccagacgcanaagtcgntggtttcgtcaacaacaaccgagtacgccttccgaaagtcaaaggggcttcttgcagcggatcaaggacttcggtgnttcggccacggncggctggngaagcatggctttttcgnnttttccgtcctttacgtgttcaaaacgaggngaccttnggggtgggcaaaaacggngcaaaaacgctttaagaaag

SEQ ID NO: 7676 - DNA, 159 bp, Tricoderma reesei
  misc_feature (1)...(159): n = A,T,C or G
nccgantcgcacgagggtacngcacgtncattgagaaacgatgctgcctttgagcgtcggttccaacaggttatcggttaaggagccatccatcacncgagaccatctttatcctgcngtggcttgaagcccaagtatgacagncaccanaaggtcaga

SEQ ID NO: 7677 - DNA, 675 bp, Tricoderma reesei
  misc_feature (1)...(675): n = A,T,C or G
aagcagcagcggagaaaaaagcagaggagaagaaggcagaggctgagacgacggcgcaggaaaagcccgacgtggagatgacagacgccgagagcgcagacgacgcgaaagcttccgccgacactgccgccacgcccacgactgccaaagagtctgcacccaaagaatctaccgaggccaaggccgaagaaaagtctgaggagaagactgaggaggccaaaccctcccccaaggacactcaaactgacgtcgatgccgatgccgacgccgatccgtcatgaccgacgacaagcccgccgtcaaagccccgaggaagaggctgcgaaagcccaagcccaangttgaaaaagnttgcngcgacngcccttcatcaaatgaagtcgatctcngatctncgagcatgtcaaagctggccattgatgccacatcgtctgctgncgatcctcgatcgaagtgtccatgtctgacgcgcccggctcaaangttgccanggagcgcgacgaggagatgcaagacgaaccggccgcaagcggccaagactganaccangaagangacggcgcttgcgacnggcacccntttggncgggaatganaatgctggtctgatgcttnacttntgttatgacagtggcgcgaccgctttgtttcatcncaaagtggaaaacgcatcggt

SEQ ID NO: 7678 - DNA, 740 bp, Tricoderma reesei
  misc_feature (1)...(740): n = A,T,C or G
aacccggnaagggggccnccaaaccggnaattaancccccggccaacccgggggtaaggcccaanggggccccctttcccttnggccttgggaatnggcccggccntttttcttnggccgncccaatttcnaacnaagggggcccgnttccaaacccccccaaagaaaccaacccgggggttcnaaaaaggttaaccccntttcggggccccggttctttggggggccttttggtttccccttcggttcaaaaggccttcggcccanccccttgggttcccgggcccggtgcctggggcccgtaccattgaaccnaccttcggaagggtcgggcgggccccttggtggttgttcgnccgtggttgganccttggaattgccgaacgaacgaacgaacaagtnaccancaattcgagcttcgggccnccggccgccggcaaccgttaacgtccgcaccgcccgnnacgtaagcgctttgggcccggcggnagcgncccgagccacggngaagcttggcgacgagctttgttccgccagacgggcgtgggcacgaaggcttctgtttcttggccttgcatctggccgtcgtttgcaggtgtcgtgggaggccttgcgttgtgttcgctgatagtggatggtggtagaacattttgaagtctcttttatacacgacatttctttatcacgtgtaaattgtacaagatgggaaagaacgagagtgtgagtgaaaattaccaagc

SEQ ID NO: 7679 - DNA, 758 bp, Tricoderma reesei
  misc_feature (1)...(758): n = A,T,C or G
ctcggccatcagcactactgagcctgctctcttgcatcatcaacgcttaacggttgttgtcctccattatctatacagccatgggaaaagaagaggatgtgattgaggttaggcgagatgttgagagagactttcaacaagatgagaagcccgacttctccggcggagctgaggaggttgtcgggatgcaagacctcgatcctgcactggacaagaagatgcacttggtcaacaatgcattggatcagatcggctggacaaactaccatctgaaactcttcttcctcaatggcttcggatacggtgtagatgcgctccaactgtccctccagggcatcattgccgtccaggccgtcctcgagttccagccatcgtatgacaaaggcctgaccatcgctctatacatggggatgctcatcggcgccctgttctggggcttcttcgccgacatcatcggncgcaagataagcattcaacatctccctcttcatctgctccgtctttaccatcggcggcccggtgcagctcccaactggggcccgggctgggtgtcttgattgccgtacccgcgtttggagcccggtggcaatttgatccttggatcgggccgcttttcttggagtatntccccntccaacaaagcaagtggctttnttaancttggctgcccgctttggttttgggaatttggatgntaccattgcccgggcntggnttgcntgggggganttnatgccccaacttttttcttgnttttg

SEQ ID NO: 7680 - DNA, 260 bp, Tricoderma reesei
  misc_feature (1)...(260): n = A,T,C or G
ntatngtcggatcggcacgangcccgtcttacttctctccttggtttcctgttatcgcaagccagccagcaaccatggccgtggcccgtcggcggccatcgtcggccgtctccctcacagccctcgtcctctcctcgacgctcctccccatcgccgccagccatgcgctgccccgagagacaaagaccgtcgccgtccgngagctcaacgtggtgccctggcccatcgngacgcccgtgcccggagccttgccgggacct

SEQ ID NO: 7681 - DNA, 537 bp, Tricoderma reesei
  misc_feature (1)...(537): n = A,T,C or G
ccaatgncttactggtnaatccacctaagtctgtctatcgacaaccagaagacaacatcacctacaaaccacaaactcaaactacacctcaaatcaaacatcaacctcaacctacatcaaccatccacaacaaaaccaccacaatggactcttcacaaatccaagaccaacaaccgcaacaaccacaacaacaacatcaacaagaacacgccccccatcggcaaatgtccttcccccctcatgtcgccagctcgactcccccgctgcgctccgcatccagcacacctcctcgtggaagcccagctcgcttgaccgtcgcagagctggagctccaggaccagaagcacgccctgcagatgagtggcattgacctcgatagcgtgcggtctggacatcagggctttaccgagaggacgtgatgtcgtcttttgtttccttctccccctctatacattatttcaactccccctcttggggagaaagagatgttgttgacggagggagtcatcatgaagttgatgaatgaaaacacaaaag

SEQ ID NO: 7682 - DNA, 390 bp, Tricoderma reesei
tattcacaatgggttggttcgacgacgactccgagcaggctcaggcctaccagcaggttaccgagcgacctcacgaagcccagtggtctcacgagctcatcggaggtgctgccgcttatgaggctgccaaggcctacgaggaccacgttgccgagaacggccaccccgacgaccacgccaaggccaaggagatcctcgccggtgtcattggtgccttcgtcgaccgcgaggttgagaccaagggccttgacttcatcgatcgtgagagggccaagcgccatgcacaggagcaggccgaggcacagctcagcaaccagtacggagaccgatggtaaatacagtcagatagaataaaatcaaaaatatcgacggtattgttcgaagccaaaa

SEQ ID NO: 7683 - DNA, 261 bp, Tricoderma reesei
  misc_feature (1)...(261): n = A,T,C or G
nagcaataanccttccaattttccggcgccaccgaaacttcnagggaatggaaaatggacatgcccnaaatggngggcaagggtaaangccgaaaaccnttgtncggccacagangntgagcccgacttgagggcgttgcggcccgccagacaanatctcggcctntttttaacacagaccgnggttaacttgtaaccacaaccagacngggtngacacggcaatctaccacangccaaaggaactggaggcggaccggtg

SEQ ID NO: 7684 - DNA, 790 bp, Tricoderma reesei
  misc_feature (1)...(790): n = A,T,C or G
tcctccccttcgccatcccgaagaaatcactgccaacagtccgactcgtgcgccaggagggccatgcgatcttaagctcaacgtcttctcccccaccaagtagcaaagactaccctcttccctcagcgccgccaggactctcccagcccttcagcgaccatgtcatcccaggtcgcctcccagaaccggttcgcctaccttggcaacgactccgacggcgaggagaagcccgtcgtccccgttaagaccgtcgacaaggttacccctcgcactaccaagcgcaatgtcgagccccaggccccccaggcccctgtgaggactggcggcaaccgccgtggtggcccggcggaaacgagggtgctttccgtgaccgcgggctggtcgcgaagcgcaaaccagacccgtcccaccgacgaggntncccgagatggtncttcgngggtggncaagcttgccgccgtccgtggaggccgtggtggacgctttccccgtgagcgtgatgacagacattcttacaaagtctggtgtcgtntctggctnttaagaacaaggttgttctgtcttggggtgcacccanggcaacgccnacttgaaggacgaagcaggccggtgaaggccatnggcgagtccgaaaaagaaggaggaccaggcccgangacgccggccgcgangagccncgttgaccccgaaggacaaaagcattttcttcttcgactacctttgcccaanaaggccgaaaanaaaggccgccttcangnttaccttcaattcngaccccaaaaaagggcag

SEQ ID NO: 7685 - DNA, 720 bp, Tricoderma reesei
  misc_feature (1)...(720): n = A,T,C or G
gcacgacattgaagactacaagaccctggacgagcgcagtgctgccgtcaccaaggctctagaggaagactatgatgagtctaccccgagggaccaagtcagctcgcgcaactggttcggacgatgcgtctttgaggcagacaatgacgtgtgcgacgaccagttcgtcacgattacctggcccgagtctgtcaagcccgccaagcgggtgacgattcagatggtggcccagaccaagaagcagtgctaccgcttctcctacttttacggcgagcacggcgagatttacacggactcggaaaagattgtcgtggaggacttcaacaccaagaagcagacggtatacactcctcatgtcgaacacaaggggcatggcggtggcgacttgggcctgacgaggcagtttgttctggcctgcgaccgcgtcaagaaccatggatgggaggcggaaaaggcacagaacgagtttgtcgggtgcaccgtggaagaggtcattcgcagccacgcaatggtctttgccgttgaggaggcccgcacgaccaacacggtcgtcaactggccgcagtttttgggatagggcgacaaaggagtagagctacggtcgcaaagtcaagttgttnggaataccccatcgaaaagcgtcaacgggtcattgggcctttactcgtcgtttttctggactggatcgtacatttctcaatggttaatacatcaattatt

SEQ ID NO: 7686 - DNA, 574 bp, Tricoderma reesei
  misc_feature (1)...(574): n = A,T,C or G
tcttcgagacagcacggtacacgctgttgctaattccctacgcgccgtattatccgacacgatccagcacgaatctccttgatcgtcgcataaaccagcatcgtcctgcgaacctcgaccacagttgatggatccggccgtctccctcacgccgccgacatcgtttcggctggcggtgatggcccagaatgcttatgaaatgccgntcaaggtcttncaggaccccgcgccatcgcatccctccctgtcgcatctctgcctgctcgtcttcgaggctgtcttggaggtggtttgcgtgagcttgccaggctacatcgtcgnngcgcatgggccaatttgacgtggacaagcagaaaattcttggccaaacctaaatgtcatgctctttacgccctgncttanttttaccaagcttggcttccaactttaatggccgannaaagctgnncgaacttnngcaattattccttggccattttcggcggnccanacacttcgtggtcatnggaccggnttccattactttggtggccaaaaggatttttcgaattaaacaaaggcggangcccttaaa

SEQ ID NO: 7687 - DNA, 671 bp, Tricoderma reesei
  misc_feature (1)...(671): n = A,T,C or G
tnaactgtcgctcttccaccggcttctacatacataccactactctntctccaccttggcccatacatactactactacaaaaacaacccagctacaatcagcagcaccaacaaatccaacaacagccacccgttccggcaacgcctcctcacccttactccaactctgcctcctcgacacaacagaccgtctctctccggccaattcgtcttcccccgctcgacctccgtcttaccccttctgcgcctagccctcgttttctcgcctctcgccatccatccgtcaaaatgactcgctctcacaagtacaacgaccgtgaccacaagggcattgccgacggcagcgtctctccaacagaaaacttgccgcgcttctttgcaagaacggntttgttgacagcgatcccaaagaagatcaagaangacgggtctggcaanggcaactggggaagtgccngcgangaagtcgtggatgaagatttccgnttaccaatgcccgtcgccgctccaacagcttttcccaccacaacctttccgactttaagaccaagttttgaggngaacgaaccttgatcctntttttgnaagantccgtccacggacccgttgatgaaggagaacggnaacgaccttttcaagaacggattcggcgagagtgttacttccgttta

SEQ ID NO: 7688 - DNA, 843 bp, Tricoderma reesei
  misc_feature (1)...(843): n = A,T,C or G
aacatgtgcggcatggccggcgagatggcccgtcatgttcttcgtgccgctgtactttcaggccgtcgagggcctcagcgccacggccaccggctccatgctcgtgccctcgaccattgccggcatgtcggggtcgctcgcgggcggctgggtcatcaagcggacgggcaagttctactggccgacggtcgccagcttcggcgtgctgttcttgtccatgatgccctggtcgtttcnggtctggcgccgctcgctctttgggggtgaaatgcttgcgttttggtcgtgtcggccgctngcaaacggcggggggcatcaccaaccatccttnatcggccttcttcgccaacgcaagccaaccgangaactcggccgtcgccattggctgcttcgtatntntttccgctcccttcgnttcagcgtcggcgtcggcattaagcttagcggtgcttcaacaggtccttcnggggcaagttggcttcgcgcatcggcaacaacnacnaccccggcaaaatgaaganaaagtgcgggcagaacctggacgccatcaangacttgccgccgttgtggcgggacaagtgccctcactaccgggtgcatatggcgtccttgcccgcgctttgtttggctcggngctttctgtacgtttgggtnagagaatnttgaaaagagganaaatgatgctntgggtgtccgtgatgganatctacactagccatggtattgttaacaacccttggaancaaaagataangaatccggaaaacttntgtaanacgnaagtccttgnnttcccggnatttgccatatcangcaaccttttttngnaacacataacaatga

SEQ ID NO: 7689 - DNA, 430 bp, Tricoderma reesei
  misc_feature (1)...(430): n = A,T,C or G
gagtacaaggtctttgcgaggcgtctcattgtcgccacggggctcacttccgagccctttatgccgcactttgacggccaggaggagtttggcgggaggatctttcacagcaagtactttaagcagaatcgggacactctcgagacgtccaaggccgttaccgtgtacggagggaccaagtttggctgggatgcccgcttacagctacgccatggcgggagtcgaggtcaaattgggtcatncgatccttttggccatggtccctgctggatcgccccnctcataccttacttccgttaagaaaaggatcgagaagcttgcgaacatccgcttctcactngttcaagccttgatttacagcggngccngccggtanacgggcattcaacngtttcttgnccggnaccttttattggccgggccntttggt

SEQ ID NO: 7690 - DNA, 593 bp, Tricoderma reesei
  misc_feature (1)...(593): n = A,T,C or G
nctcgnccgattcggcacgaggcttnctttatgcttttgcaacttaattcatcagtcctttttgacatcgtttttttttgagggcggccgnctcgcacagttntggcctttcagtcactccttaagacaaacaaccatcatttacattctatatcgttccttgacncctatattngaatctcttcgtctgcctgaccgagcacgagaagcacacgtccaatcgctacagcttcaactcaagaaccgcanaggttcacgactacttttnaccagaaccnccaagatgagcttgtccaagctctncgtctccctngctcgnactggctggcaccgccattgctggcgatctcccgtccatcacggccaagggctccaagttcttctaccccaacggcacccaggttcttcattaagggtgttccgtaccaccangatgttggccagncccggangcaccngactcnagcacctcgaccttaatngacccccttctccaagcgaggccaactgcaancgtgaacggttccttttgnttggaaagcaatctggngcacccaacgtcgatntcgaacnttacgccattcgantcctca

SEQ ID NO: 7691 - DNA, 634 bp, Tricoderma reesei
  misc_feature (1)...(634): n = A,T,C or G
nncggtcgcatanntccatgtgcggtgtcaatcactcgcagcctggcccgggctctcaccagacgccttgctgctattgctgctactgccantactgctgtcagacccaagtttacacccgtcacagcttttgccagatcaaagtcaaacatggccgaccagaccatcgtctacaccaaggatgcccccttccccctgggcccctattcccaagccatcaagacccccacggncatctactggttcgggccaaaatcccccctcaccgccgatggcaccctgnttggagggcacccattgncgaaaaagattncgnttggtgctgcgagaacctcgaccgcttgtcttcaaagcaggccggttnttccttttccaaggtcgttaagaacgaccatttntattctccgacatgggnccanttttgcttgaantgaaaccgggagagtncgaaaaggtttttctccacaagccccgcccgaaagntggngtggcccgtnaanacgctttcttaanaaacgttcnnctttgaanatgganggncatttggcccttgctttnaagggtanaacggnttgnttggaaaaaaaanggctggtaaaaaggtttaccatnggtnccctaatacataaaagtt

SEQ ID NO: 7692 - DNA, 381 bp, Tricoderma reesei
  misc_feature (1)...(381): n = A,T,C or G
naaagaatctngttagcggtggtnttccnttacggggttnggnttgtggggttggtgnaaaaaattttatngggtttnacggagncaaaccgggnaaaggattaaccgggcnggatttgggtttgaaaanaacccaggaattggggggttttggggnaaggggcnaattnaattttgggggcntttngtcttgancccttgcggggaccaaatttnggttnaagggaaaaaattngggaanggaggaanctttgtnggaactgggtttccggncggaggaattcaaggaaggggcggantaaatcctnaatngggttttnaaattcntaccattggangaccaaaaacccccgagggaaaaangattaattnatgnatggt

SEQ ID NO: 7693 - DNA, 721 bp, Tricoderma reesei
  misc_feature (1)...(721): n = A,T,C or G
ggcatcagagggcagacactccctcatccacccacaagcggaaactcgaccatgcggctgctgcgtctaaagacgagcgtgagacagacaacgacgtggacgaagaggacgaggtccggaggaaacggagcagacacgcatcacccgagaccggccgcaggaagccacagggaccctcgcagggcgtccaagtccagatgccctcgcggtcaacaacgcccgccgactcgcaacactctggcagttcggcagcggcgacggcggcggcaaagtctacgacgaagctggcaacctctcttccctcccgccaggccagcaacctggcaactccggcgtcatcctcctccatgagcatccaacaagaagcaccaccacaaccacaaccacagccacaacaaccgcaaacgcaccccccgcaacccccagcagcatcaacatcccaaaaccaacaacaaatcgacgaagacgaatgggccgcttcgaagccgacatcgccgccgaaaccgcccctacgacgccgacgccgtaatctnccgtcccgncatgaccgncgaggaagcccgccgccgcaaaggangntggttgctgttgctgctgctggttgagcaaggaacttttcgagaacccttgaatnttcgcaagacaaangncagacgcngacattgaggacnagcgcgaanaggctacncnggcgcttggaggangagtttgagganatgca

SEQ ID NO: 7694 - DNA, 271 bp, Tricoderma reesei
  misc_feature (1)...(271): n = A,T,C or G
gggccttctaccgacggcgtgtagtcccacatgacgaggggaatttcttgaggaaacaagtttctcgaaaaaagttttcaaatgcctaaagcgagaatatctatccgagccaacggtgcttacttttttttctcttttgctncctttctttctttctttctttctttctttctttctttctttctttcttncttccttccttncttacttacttccttccatccttccttcctttcttacttcttcctgncttccttccttncttcttctt

SEQ ID NO: 7695 - DNA, 394 bp, Tricoderma reesei
  misc_feature (1)...(394): n = A,T,C or G
nttttnagacnatcngccgagggagcttcatcaccatcatcatcctcatcatcgccatcatcgncgccatcagcttacactcacacgtgcagagctatcgaaaccttccttggacgcacagtcagcaagacgccacaaacttgtttgaccacccgatatcatacataaagagtcgagtcaagacacgacangaacaaagaaacaaaagcaaaggatacatccctacctagacggacaaaggggacaaaggagcaactaatcactccgcaatcccatctcctnaacgcccaacagccacgcttaccggnagacacnatcatatcacaccgggctctaatttntttntggcttatcctccttnaccggtggctncccaccatcgggcgcctntttt

SEQ ID NO: 7696 - DNA, 892 bp, Tricoderma reesei
  misc_feature (1)...(892): n = A,T,C or G
caagacgttcaactcgcatccatcaaatccattatcggatccaccagccgagccaacggctttcgattcaagtcccgtccgaaatcgactcgactcgactcgactgaaaccggctcctgtcgaggcaaaaagacccttgtcgctcgtcctgtctttttttgccctcgcggcgtttctcgcgccccaccactatcagcctgggccctctttcttcggggccacacggccgaagaggcgaagccatctaggggagttcccacggaagccctgcctagccactcagctttgtcagagcaaggcgtgtgagaagaagtgtgtgagaaaagaaagagagggagagagcgtgtgtgtggtgtgtgtgtcaaaggctttgtcgggaccggcccaagcaagacgagccagggaagtcggcggtccttgttccatgcccttcccatctttggtcctgtccctgctcgctccgtgtcaagcccattgagatctctaacccaacgggaccgagtccgtttgcgtgcgtgcttgtctgcgcattttcngcgtttccaccttctctttttcccgtccttgcttgactctctcttcttccttttctcttcaaaccatacctactcttgngtttattttacccttcggatctttccccaggccattgggtttttcttggtcttgtcttgcggctctgccacgccnggaccatgccgcctttaacccttttcctcggtgacnggacgtcatancttcagtcttcttcgatatcaggttagaaganaacttattgtctttccgcggaaacnaacaggaattcgtccggacagntcttnaaggcgtgncggggctattgtttttcttgcccttccgctggaggacatcnccttcgcctggatngggattt

SEQ ID NO: 7697 - DNA, 1654 bp, Tricoderma reesei
  misc_feature (1)...(1654): n = A,T,C or G
ccagttgccatccccgatgacttgatcaacaccgctgttgaaaaggagtctgaggcgctggagaagccccaggccatcaccgagcgcgtctggggcttcgcggcccgtatcgatcccaccgtcaccttcgaggagtaccagtactgggccaagatcgaacgtgaggaggagtaccaggcnaacctcgagttcaaggctgagcacgggccccgaaccgtcaagagcgtcctgcttggcncgcttctccangggcatccaccacgagaataagaagaaggccgaggctgctgccgttgctgctgctgccgctgccgatgctggcgatgcctctccaacagatgagaagagcggcatcgttggcgcgccgcagaagagcgtgagcctcccgactgaggcagaatggaagcaggcttctcgtgccatgcgaactgccagctggggcaccatgttctacctcatcacgactgacatcctgggttggtcgtcaaccccgttcgtctttgccagtgtcggcttcggccctggcgttgccctgtacattgtctttggtgccgccgctgccttctccggttacatcttgtggaaagtcttccttggcctcgactcgtctcgctaccccatggtttcgtttggtgacacgtactttcgcgtgtacggaccgtttgccgccactttatcaacggttgcccaggccatncagcaatttcatgaaccgncngccgtgcntgattttcgggcangcgggcaaccgaccaatttggcttcagcttgggccaagccgnagaaaagaatcctgcttcatcgcctgtctcatcatcttcatggnggngggcatggtctttggcagcatncgatcttttgcagcgcatcggctggctcgccaacctgtccgctggatcaacaatggcttcttcatcatcatcatggttgcgtgcgccaactaccccatcgactactccgccgtgaccagcttgaacgttgatcaagaccattgagcccattaagctgtttgccggcctttcccccggaccagtaccaagcaagcaggccacgggcttcgccgggccatttcaaacggcattcaaccaagatggtgtacagctaccggcggtggcctgctggttcattggccttcctcgcccgagatgcgccacccttgggacttttggaagggcatgctctgcgcccagacctttatctgcatcgtctacatcttcttcggcgcctttgtctatggccactacggacagtactctgcctccaacatcaacaacgtcatccagcctgtgagcctgcagactgcgaacaacgttctcggtttgattaccggagccattgcttgtctcatgtacatgaaccgtcggcatgaagacagtctacgtcgaagtcttccaggagatcctcggcctgccccgatcacgacccgcagcggccgntggctgtggtacgccctgggacccttntactgggcctcgccttcgtcgtcggngccgncgtcccaacctgaacggnatcttccgnatcgtcggngcccttctnattcttaacttcactacactttcccgggcgttctgtacattggataccgcattaaaggcggacgcccgncttgcccggggagggcttttgatnccgtgaaccgcgtgacgacccg

SEQ ID NO: 7698 - DNA, 493 bp, Tricoderma reesei
  misc_feature (1)...(493): n = A,T,C or G
cgtgctcgcgtcttttgcgtcgaacncggctccatgccgtggcaggacggcggggctgtggcgttgacggcgacgggggcgtatgtcctcgcgtacctgggcctgtcgcagcatccgccctttggagttgttgtcttcttgctcgtgttgacncgggtttgggagcgggctgataaatgggagctggaatagctgggttgggggcttggtttcacgggagcacgctgctgggctttctgcatgggttctggggggctggggctaccctgtctnccatcttggtttgtcgcttcctttttcttcttcttgncgttgtttctggtgtgctcaggctttatttggcattgttagtaatgngatttaattactgatgccctgctgtgtagattacgagaattgcgaccaangtagagcattggtngatcttctataccatganaaccgggcttgcttgngtcnactgccangcgtacatnctcttttggnacacgcc

SEQ ID NO: 7699 - DNA, 206 bp, Tricoderma reesei
  misc_feature (1)...(206): n = A,T,C or G
gagactcttccagacaaaaagatccgctcaactcgaaaccgtcaccatgtccggccacatcctcaccctcagctgccccgacaagcccggcatcgtccacgccgtcaccggcatcttcgcctccaagagccacaacgtcctngacctgcagcagttctccgatcccgtnaccaacagcttcttcatgcgcgtgcactttgacacgg

SEQ ID NO: 7700 - DNA, 322 bp, Tricoderma reesei
  misc_feature (1)...(322): n = A,T,C or G
cttctacaatgcagttgatcagctccctcatctgtctctccctctccgcctccgtggcccaaagcgccatcnccattggcaatcaaataagagaaggaggaacgcactacaatgtggcgtggatcgagggcatcaacccatgccaagccgacgtcgccatcggacccgagagcggccgcgagtgcaacaagaacttccgacttgacggcaccgactactatctcgtcggatgtaccgatcccaacacgggctacgcgcagaatccgcagangctgaggcgggtcaaggatgattcgctgtatngaacctgtgcgcctgtgaa

SEQ ID NO: 7701 - DNA, 160 bp, Tricoderma reesei
  misc_feature (1)...(160): n = A,T,C or G
ncggaaagggcnaaccccagctngtacacanaaatacccagacacgcgtccngcgaaaagtcgatacaaactaaggtaagantgtcggaagagntcgctgaanatgctttagntccctcgcanangatccgcaggggnctttggtnggatacatggaaac

SEQ ID NO: 7702 - DNA, 657 bp, Tricoderma reesei
  misc_feature (1)...(657): n = A,T,C or G
caggagacgagctatcaggcctacagggctagcccctatgaggacagctcgatgggccgccaccgcagcccgctctatgcgcaggacaacggcagctcgtctggcctggtgcacaacgcagtaggcccggccgtggtgccggcaccatatcgagacatgtctcacgagcgagcgccgagccccggcctccctagcggctaccacaacgtggccctggatcgggctcggagcccaggggtcggtgtgccggcgccagtgcccggcccaggaatcggcgggccgcggggatacagcggcctgcctcagcaggaagacacagagagccaggagatggatcccatgcagtacaactactttagagggggatccnggccgacaaagcctnccggacagggctggtaaaggaagagaangaatgtgaatagacnggaccaagatgatgaagaaaagatatatatttcttgtatttgacacagtgggttaactgcatggcgttttggatttagactanatggccgagaccatgatgaattgggttgaaaaataggcacggtgcctttgacattttgagatttttatatgaatacaagtttatgtctgactttttttttggatagcgaaaaatattaacgacactttgtatattcnaaaattttg

SEQ ID NO: 7703 - DNA, 270 bp, Tricoderma reesei
  misc_feature (1)...(270): n = A,T,C or G
atgcatgcacccactctcacatcggctacgagggcaccgacgccttgacccaggtcacctccctcaacttctcaaagtccgaccgcgatggcttcaggattntcacaaaggtnatgatcctgcaccccatngccgccggcctcaccttcttggccttccttctctggctgggcaccagcttcctcggntcctttgtcgcgtccttcttctcnttnctggcctttgtcgcaccgtcatcgccatggcctgcgactttgccggcttcgagaa

SEQ ID NO: 7704 - DNA, 673 bp, Tricoderma reesei
  misc_feature (1)...(673): n = A,T,C or G
gcnctcgatgccgagacgganacgtcccagtnttgnatgatnccgcnatggggcaccgngtacctgctctcccacccggacacggtcantcatgtatcggtcgaggagctgaaacagcccatgcttacgtttggcggccacttgctctccctgctgggcactcctcagtccggatctctgcctttgcgactctcgaccttgggtcgcatccgatctactgacctgttgctccgtgcatcgtctactctgggatccnttgcgaagattgtctnttgccttgccttccatttcgatccctcggagcgtcgcagaccggtggtctccaagaacnatncatcaacctggaacttggtttgcgnccgatctttggcggacccgaangacttgatgcattgcnaaaaatggccgaggaagaggcanaaaaggcttttttttgagaaagcatggnnggacaagntgtatttnccggacaacacaagattgccgtctacctgccgttgcttgggccggcgttgtgccgttgatctggggctnatcaatganatcaagaactcgtcaangaggcnaacaanaangccttggatgctanaancaagaaacatcagtagcaagcttggctanattngttttttggttatacaataataaaaaaatcccacggtgccttttaaaa

SEQ ID NO: 7705 - DNA, 544 bp, Tricoderma reesei
gaagtgtcttccctgattcgcacctcgatcgaggagacgcctgcgggggagcgcgtgctggtgctgggctgcggaccggacggcctgatggcacaggttcgcaacacgacggcggcgtgcatccggtccgacgggccgggcgtcgagctgcactgcgagcagtttggctggtgatgccgggatatggccttgtgcttctgcatcatttccctttcgtctatctgtctgttcaataacgtcgttctgtgcctctagaaaagtgttttttttttctttgtctcgtcacatttgcagcatctgtcgtcatgtccgtcaaggctttctggagtttgggtcatttctttgcatctccggtgagatggtataccatgtcttttcctgttccctcttttctgttgtcgtttcggaggaaatgagccattccttgatatatggctcttgtatatatatcggttctcctgatttcgcttggcgaaacatgtacatatgatgatataaaagtgcgccatattatgttcatatgttaatataacacaaagcatgc

SEQ ID NO: 7706 - DNA, 407 bp, Tricoderma reesei
  misc_feature (1)...(407): n = A,T,C or G
gattttcgtttccttctcttgttcctcttcgcgccttataccctcgtcgccttgatcctgtgtctcgattcaaattcttcacctctcgtcttccttctcctttgttttttctcctcgcccctttgcgtcgcttttttccccgatctgcgctccttttctcaacggcgctcgtgacccgattacgacatcaccaactctcctcaaacaccgccgtttcctccgcgctgcgtgaatttttttagcaaacaaccatcgcaatcatgtctgggcgttacgagagggtaaatgcccacgaagaagacgaagaacatgatgttcacagcgccgacccaaatcccaactnggcaccccggcggttcactccgggccttcttggcgacacgaaatgggcgggtcaacaacgatct

SEQ ID NO: 7707 - DNA, 624 bp, Tricoderma reesei
  misc_feature (1)...(624): n = A,T,C or G
ctttaaaaacctgcgtcagttgtgcttcttgactttctcaccttcgtctcacgctgtcgtctctgcgcttccgactctcgtctgctcagcgctgcagcttttccaatatctgcctcctgctccccaactctcgacgctctatctgatggacggtctactcttccacaatcccatcaatccatcattcgacgctctcgcacacaacctcggctcatccagaccaaagcgcaaaccgacgtgacgcagtctgtgttttcaagcgaatcgaaggggagaaacgagaccggctacccagggctgcaagaccaggacgaagtggacgtctgattcccagccatttccttgcattggacttcggacgccggcgactttggtcaatcatcgactatctagcttggaggntggctggncaacagaagccacatcagtagtcgacctcgcaagaaccgatatctctttcttccttatcctttcaaatccacctgcacaaagccttgnncacaagtgagcatctcaaaatgatgaaccacgcccgagtcaaagcccttcaagggcaacgggaagacagtcttcaagaaggcgatcaagtcgggtcgtgcgtcggggcgctagcacgccgcgagg

SEQ ID NO: 7708 - DNA, 662 bp, Tricoderma reesei
  misc_feature (1)...(662): n = A,T,C or G
ncgttntcanaggacaacgagctgtcgcgcaaggctgtctaggagatgaaggaagtcatagtanacttggagcaaaggctcgtngaccttcgcaaggaccccctcagcgcaagcgacctcctcggcgatggcgccaaccccctgggcggnatcctcggcgcncgctttgccaatctgcttgccgacgtgccangccccccgtcaaaangggcaacgaanaaanccctggaccttgacgggccttngtgccccaagaaaaaaggccanggtggatgaacgccnaacccgcaaccgncaatggttaagcccaaggccgacgacnagtctaccgaacttgaaaccaanaggaccaaggtcgaggaggaacancaaactgtggaggcgganaagtaatctatcggcgcncttgatcaatttccacttttntgggttccancattcgaggaccaaactcngatgaaactttatttgcaaatttggtttctntttttttggcttgggcgancccattttgaaaacccgattcccccttttaanttngggggggaaacaaaaaggaaaggaatttanggcgtttggaaaggaaaagggggatnggcaaaaaaaactttgntntgaaaaatgcttttccaaccaaccaattaaccaacnaattncccntt

SEQ ID NO: 7709 - DNA, 413 bp, Tricoderma reesei
  misc_feature (1)...(413): n = A,T,C or G
caacttcacctacaatgcaagccactagacgacaagtattatcctcggcccagcgccttgctgctggtgcctccaacagactcacacgaccagccattgcacgatcagccctcaagcccctcctcctctcagcagccccctcagcacgactcctccccatctcaatagtaaggacatatgccaatggacgtccaaacccaccaggagggacccatnggatgaacatgggaggaggtgangcaggagaagcccgngctggaacagtacggcgtggacttgacagncaaggctcgcgagggtaaagnttggacccggtaattgggccgagacgcagagatccagccgtcaatccaagatcctggtctcnggtnggacaanagaaacaattnncggtcccttnatcnggaaaatgc

SEQ ID NO: 7710 - DNA, 322 bp, Tricoderma reesei
  misc_feature (1)...(322): n = A,T,C or G
ttttccccctaaatacttccatcaacaccccccaaactcctcgactctcagtcaccgcgactcgaccgaccggaaaaatcatggaggaggagcgtctttggaagttcaggaagcccgagtggctcaacagcatctgggcccggaacgctggcgtctacggtgccggagctctgttctccctcgccttctatgtcatgctcgactccgccgtctggtccaaagtcggncaagaaacggatccaacgttcaccgtcaaaattccgtcgactnggctggccgctcatcttttccaagcctcgggcatgcttaatcaattcaactc

SEQ ID NO: 7711 - DNA, 861 bp, Tricoderma reesei
  misc_feature (1)...(861): n = A,T,C or G
cttttctgcttgcctcgcctctgacactgtcagccacgtctcttggctacgctgtgccgaaaaaagaagccgtttttagaccagttttccatccttgctgtgggcgttcgcgttccgtttgttgggagcatatccgccgtcgtaccttggctctctttcttctgccccgtgcaacccgccgcatctacttgtactgcctcccagaccaccttgaggtctcgaagccattacgacgactgacgccccgagacgagcgacggcgagctctctgacgaagcaccagtacgagcgcgagcacgagaacgagcgcattggcgatctttgttttggctccctgtccagcgccgaattgtgacgaagatacaccgccgtcggtcgattgcgcaatatttcacccgcgacctcggattttactcgatagcctcaccgggggcgcctctcgtgatatcctctacctccgcggaagtagcccgccctttcgccaatcccgccatttctcccgaaaactcaaagcggcgtctcctgttccgatccggtcaaatcctntcttctacccggcccaagaatatcatgggcaaatngcagtcaaaactcttcgcaggagcaagctcgccgagctggaagaagtcgacttnattttgatnagaaaggagttgagcagngggtacaaaaggttttttgaaagaatggcccttcggcattgctnttcaaaagaggagtttcagaaaaatttaccggnaggttttccatttggagaccgngttcgttggccgattgtattcaacgggtncatagcgacaagtttggnancattcgnctttaagngttatttgcgccctgagcggtaaccaccngggaaaa

SEQ ID NO: 7712 - DNA, 905 bp, Tricoderma reesei
  misc_feature (1)...(905): n = A,T,C or G
catctctccttcagaaccctcttcaaacctagaaatttccacctctctctttcagctgcctgctgccattctctcaagccacacgcctgctttcactacacactacaacttttcttttaactctctcttcgctcctttgacatcatctaccttacctattcgcgccagacaacctcattcaacaactgcttcgtccctttgcaacgagcctcttttgcgcctcgtttttttcccgtccttgtacaacacaaacaaacgacttcgatacccaggctgtaaatcggctctcaacagaccaaaaaaccacacaatcaccttttattccctctacgttgtcacattcaaaccatggcatcaatcctagggcaaatcatccccctcgtcatcggcatcggccttcttagggggaccggctgggtcctttaccaagatctanccttttccttcgccgtgatgcgcgactccgcctccgagcgcatgggccgcagcaacgtcgtcttcacaaaggacggcgtccgcgtcggcgtccgggccatgcagaacgaaaagtacgtcgacaagacgcagagctacgtcgtcaaggcgtggaacttgggcaccgcgcagagggacgaggaaatgaaacgaaaaggctcgaaataatgaagcccgaggaggagagtgaggaacgagcttgagcttggggatgatggcaatctcgacgaattgacatgtgacaggagagcgcggcacgtgcaagttacttgaactgcttgcagtgatgggaaacgctgagtacctntaccggttctnttaaagggtcgncatgcatatcctatgatgnaactntttnttatnttgnaaccgaatgcacccncttcccgataccaattccattacaagcattttgatganccgcaaaaaaa

SEQ ID NO: 7713 - DNA, 349 bp, Tricoderma reesei
  misc_feature (1)...(349): n = A,T,C or G
ngncgccgaggccaaaccccaagctgatcttccaangaggaagaagagactgccgccaccaccgangccgccccgtcattccttccgtcgangccaccacttcccttgccgtcgatgtcacaacccttgccacccgtcccactgaaaccacttgangcttgttgtgaccaacggcgaaaaccaagaaggacaanggagaagcccaagtctttccttgcctttacctttggcaagcgtgacaagtnttccgggccccggcttccganggccaagganaanttcacaaaggggcccttnttcaagcttcgtgctacattaaaggcaanggcncccccaancttaaggacaa

SEQ ID NO: 7714 - DNA, 372 bp, Tricoderma reesei
  misc_feature (1)...(372): n = A,T,C or G
nagngcgccgantcggcacgaggtaactctgctgcgtccttttcgctttccacccgctgttcttcctcttcctcctcttcctcctcctcccgccaatgcgataaacgcatccatctctcttctctctttccgctcttgcatcgccgatatcgtcaccaacacgcccttgcagtactctctgccctctcaccaacccaccacttnttccctccctcgtgccagatcgngcaacccgactccctngacctcccacgcttcgaagcgcgcattccgctgccgccaccccccgacttcacgatagctntctcaatcctgccaatccacccccatccggcccgtcgcgatggctgacttcccanccaaatgctcgac

SEQ ID NO: 7715 - DNA, 545 bp, Tricoderma reesei
  misc_feature (1)...(545): n = A,T,C or G
nncgattcgcacgagcagtgcctgccgtcgctaaangattggacccgagagggaggagagaagaagaacgttctggatggccttttgcgaggatcgctatgccagcatnggcnccggttggcccatgacgatcgacgaaaaggacatcaagaccaacatgccttcgtcggacgaagctttcgacatgagtcgtccggagcagacgcttactctggaggaatgtacgagcccatctggggccggcaagctctcgtcctttggcggcatcatcctcatggcctgtctgttcggccgcaacctgattcatctacaccggcccgacgacgacgacctcgaccacgacatcaacggcccgttctggaagcgccatcgacaaatggaccacattctcctcaacacatctctctgcctttcctcccaccttnaagcttcccgccggcctggccaaaccccaacggttgtatttaccaacatgagcattcacacgtcaacgatctggctttcaccaaggcagccatcttnaaagcggaggcgaaacaaagctt

SEQ ID NO: 7716 - DNA, 660 bp, Tricoderma reesei
  misc_feature (1)...(660): n = A,T,C or G
gttgctactgcccctgcgtcaatgagggatgaagggatgaagctgctcagttacacccacgtgctcgcgttagagcaggccatcagcgtcatatcctctggcgtcccccaagaacaaatgctgcaaggagcgggcgttctgtcccaattcctcctggcctccgcatcgggcctgtcgccagtcgacaccttctatcccgctggcctcaacgacacctcgtacatcagcaacagcgcgcttggcacgtacggaggcacttacagggcgccggccaacgaggctttgcagggctcttcatatggcatctacgactactgctcgatgccgcatccgcgcgtgagcgagtatgagatgcccaaaggacccgtaaccgccaagctggtctatctcgagtatatgcagagacaccagaggcgtaccatgtacaatctggcccctggtggagagaaccaaccatttgattgctcaaagctttgaagcattctcatacggcagtcaagcacacggcaccagtggtcttcaggtctacgccagcgtctacacagacccgaacaacccgtttgtcgatgctcttgccatacgtcaactcgacatgcttctttcctcagttgacactggcggctctngacggngtccaacacgggaaggatctntgggctt

SEQ ID NO: 7717 - DNA, 669 bp, Tricoderma reesei
  misc_feature (1)...(669): n = A,T,C or G
cgcaccagagaaggacgaagaccctgtgcgtcatgaaggcctctgggttaccatcacgccgaccagcagcgctagcccattcttcgacactctgcttgtgcttgtcatcagccccttggtgacgctctcgattgtgtacgccctcttggtcttgcgcgcgaggattcgaaggaggagatggcgggcccccaagtccgtggtcgagcgtcttccagtcaggacctaccacaccgttgcccgctcgcccagcatgtctcccagagtgccttctccgggcagcgcaacgccgacgacgccgttgttgcagcacaacaacagttccagcccgcccaggtcgagacctcgctccaggacgaccactggggtcttggaaagtgcaaacttcctggccccgactcccagtgacctgtcactggcgccgcagaaccctcgccctaccgctcagggcacgaacgaggagccgtctcggcagagtggaaaaagtacatgggaaggcaggtggaatgcgtcgtctgctttggaggagtacatcgacggcgtgaagtaagggtaatgaggcttccttgnggccacgaatttacgccgactgcatcaccccttnggttgaccactcgtcgacgaacatgtcccatcttgcaaagggggatgtagttccgctctttggcttcg

SEQ ID NO: 7718 - DNA, 703 bp, Tricoderma reesei
  misc_feature (1)...(703): n = A,T,C or G
ggtcgaggcctttggcgcgcagacggtccacatggacctcatctacgaccatccggtgctgcagcagcctttgctcctcgtccaggaccggtcatcgtgcgcctttgggggccgatacacgaggcgggcgcacggcaacctcaacgtccggctcagcacgggcgagtgcgacgccaggaacctgcggctcgacgactcgcggcccaaggagtgggcgtggcggagctccgtgtgccaccggtgccgtcccggcgaggaggtccagccggccgaggactactgccggttcggccagtcgccgtggcatctcatgtgctggcactggccgggcgagtggccgacaaagtgtctcataggagccatggggtggctctgcagctgtcgtcaagcgtgagtttttctttttcttcttccattcttttcttcttcttctcttcttccctttctcggatgtctcacatctacttacatacatacctatactactacaatgagaatgtatgtattatataagatatatggagggcatcgacgtcctatacgccacaaacacgttccacaccgcagcaaggnaatgatcctnagcctccgtcattctcttccgagcgncttgccagcatcgcgtcggtgganctgctgngggactttgcgccctttccancattcacccggaggnggtnaagccgccgttgtcggacattgg

SEQ ID NO: 7719 - DNA, 590 bp, Tricoderma reesei
  misc_feature (1)...(590): n = A,T,C or G
cggattgacantgccaaagacgtgctgctctgggcgaggtcatcatactttggcctagaagatatgaaggccaagcaaggctgctggacatgtaaacgtgggttcactgttctccagctggcacgctctggcggcagcagctcggatgcctctgctgacaggtgccgtaaaagagcggaaaatagggtgcgacagggatctgcccgtgtgccacaactgcacccgcacgggtagacaatgccagggctacggacttcgtctgctgtggccggatcgccatgatggccggcgcaaggacagtggtttcgtggtctatgagcctccagagaacccgctcgaggcttccaagagctacggagtgcacttctcaacgtcaatcacaatgatgtcgctctgcgctggacccgacatcttacaatgccctcatacgaaaactgttgccaagcctacacgggctctcaatctctatccgacaatgatcngccaagatgctctgttcatgtcctactacgagcgcgtattgctccgatgatctcgacacttcaagtccagaaccgntttccgacagatctttgtccagatngtgttat

SEQ ID NO: 7720 - DNA, 717 bp, Tricoderma reesei
  misc_feature (1)...(717): n = A,T,C or G
cacatatacacacacccgcaccaatggcccgaataacaaggatgcggagactccagtctctgcaactggccgtcccatcacaatgcgccgccgcaccccgaccgtcctttgccgccgcccgcgccatctcgacgaccagccccgcgcgcagcaagaacacggactggatccggggcaagctgtggaagggcgaggcccccggcccggccgacccttacacgcagcggatggagcccgaggcgcanacaaacctgccggaggaggcgctcgagaacagcagcagcaagcaggtcgcgccgtgacaagacgccggccgncgtgccggaagtcgaggctggcgcttgncggcaggaagacccgaggtcgcggcggaaaaaggancttgaaggcgtcggacccgacgtacgttcctcttgcggacnccgaaaggcttgaaggaaaattgggnccnttgagcacgtggtgggaacaanccggccacttgggccaagaagagcgagttcaagggcttttggcaacgcccgtaaanggtcgtgganaaagaaggttcttggangtgtattttgcaacgggccggtggtggaagcncttggccttnaacaaaaaaggcgtttttncggaatgggcntnccaaaaaattgttccaaggggggggccaaagggccaaaatggaacaancccctngttgtncaagtggaggtccaggatggcaaaggt

SEQ ID NO: 7721 - DNA, 241 bp, Tricoderma reesei
  misc_feature (1)...(241): n = A,T,C or G
tctnggncctgagagctggggattgganggcaacttgctgtgcgcacanatagagaaacggngtggacgcgtgatgacagacagcggaatagacattcctcgcccgacttcgataccgcatccagatacagcaactcgtcgagacgaagccgctcgccgcgcggatacaagcgctcgcgcgatgacagggatcgcttcccaattgccagagcccgagatcaagactctcgacgtggccgcg

SEQ ID NO: 7722 - DNA, 692 bp, Tricoderma reesei
  misc_feature (1)...(692): n = A,T,C or G
ccgggnttctgcgccgngntgctatcgctggctggcaccgcatgactccttagttgccgcgttcttgacctgcctctcctttcattgntctactttctgaacagcctttgatttcttccactaaagaagacctggtgtcctctgttgcgctctcttccggaagagaatctgcccgttgcattcacgcacatttaccgaccagacaaaacgcatataccttatataccttatatactctcgcatccaagcacatacgcaactcactcactcactcgatcctcccacacaacccatcccaacaacaacaacctactccctttccatcatgcacttctcaactgcttccgtcgtcctgggcctcgcctccctggccgccgnccagctgnccgccgtcgccatcgttcagaagatcgcgcccacggncacgtcgtgcgccgactcgagcgagtgccgacggtcgagcaggcggcgccctttatcgcaagagcatgtncgactacggcatctacacgacgccccgagatggccgccatcggtgtccctgatggccttttgagtcggtcgagttcaaagtacaagcacaacgtgtngcccggccgggccggncanggcaccgncaacatgcagatgggcgcagttcaaccttggcgtacgccgctgancattcccagccttaanggccaggntggcca

SEQ ID NO: 7723 - DNA, 976 bp, Tricoderma reesei
  misc_feature (1)...(976): n = A,T,C or G
cctacacgcttcctctcaatccttgaacaccaattgttgctctagcgcctatccttcactcatcactcgcctcgtacactaaactcttcatcccgaacagacacggcttgacacaatggcaccgccaccgctctcctacaccaaggnggntcactcaaccacctaccctgccatctntnctaactcgcccgccctgtcaactaatggcaagggcgncctcatcccggtgcctntggcggnattggccgngccaccgcgncttctacgccgtttngggaccgcgagctcttattcttnttggacgccgtctgatgccttggcccgaaactgaggccctcgtgcggtccaagaacgccgatgtcgtcgtgcagactcacaaggtcgacctttgcgacgcaccagccgtccgcgacgtctttaacaaggtggcagccgaattcggcggcatcgacattgtgattcatgctgctggcgtcctggcccgggttgttccccttgttgaagctgatcccaccacttttctcgatggctacaagacgaccgttgtgggaacgcttggtggtggacaggctggcgtcctgggcaacaaggagaaggagtttacactcgtcaatctcacaactgcgggcattctcttccccgcttttcccggtatgggtgcctacgtgagcaagcaagaatggggggcgtcaaagcttcttcaatccttttggtggcgagaacccttaaagtgcgccttcacaacgtgcaccctggaattcctcgacacttgccattgtctgcccagttgtccaanactaccaagctgcctttgattacgacacatctctntttccgcaaactttctcgtctggattgntttttccganggcaaagttccttcaacggnaangctttgtcttttnttgctngggaccgttgatgancttaaaancccgcgagaangaaatngttngggggccttctgggaaccggg

SEQ ID NO: 7724 - DNA, 812 bp, Tricoderma reesei
  misc_feature (1)...(812): n = A,T,C or G
gatcttatctcccccaacatcccgttcgacgaacagggcaacctggttaaccaagctcccggcgcaccccccctcgagcaggatctcggctccatggcaccaccgggatacggcgaacatgtgctcgaccagctgtatgacgagatggacgtcaccggcttccagacaccggccgtgcattctggattcaacagccccttttacggacactcacgggcaggttcctcggagaacttggcagccttggccaacagcgcacccatcacgccggcggcgctctcgtctcggctggcgagcgtctactggatcagtcgcagcggaatagctcgtatcaatccatccaggctgcatctggccgcacctccctacccacggaaccagtcacacgtctcatacgccccataccccacagactccggcacatttgagtcggacaaacagcgaagaggaggaagccagtgctcgaagctcgggagaacgagcccaagtagataccggccgaattcgccaattgaatcgagtgccgagctattcaactgcggtcaagacgcccggcacggtctcggacctctactggcttctctgccccagactaccaaacggcctgagcgctccgcggacaccggcgaacatggagctcaacggcagcaacgacgcccttgtcgacgatagctgagcacgcacttggcganggccaaganacgcgcgagccgcacatgcnaagcgttgnttgggccctgtccccttcgatgggccggtntcagtcggattgacaacttcgatacattcgganggtacatntgttccggcca

SEQ ID NO: 7725 - DNA, 168 bp, Tricoderma reesei
  misc_feature (1)...(168): n = A,T,C or G
ntgaacccaggngggggggggggcccaatcaatttnttaaataaacccaangtttncccaggggntgttggaaaaaacaacctcccnttttgggntttttgcccaaaantttgnatgggttnccnttcggggntgtttcaggggccggttttcccttttnnacccaat

SEQ ID NO: 7726 - DNA, 484 bp, Tricoderma reesei
  misc_feature (1)...(484): n = A,T,C or G
tctttctttttatgctcttactctcctcctcctcctcttctgctccatcattcgcagcatgcccgtgtcccgcctgacgccctcataataaccaactaagccgagccaaaacctccactcagacaatgacgatatccgtcgacgagcctcgaatgcacgcagttcccgctccctccatcgccgtcatggccagcgtcaacggcctctcgaccgagggcaacaaccaccaccaccacagcaacaagaaccacgacaagcacattcttccttccattctncatcacacccacaagcgcgagtccggcccggcatacnggtcgctggacgangcgtgcgtcgccatganggccaaggngggacnctttttgnngaggagcccgggacagcgcttgttgcgganggcncagaacaggcnccctgtcgntgcctgtntggaagaagccctggaaaaantcggccggaggancttntttatttntacaac

SEQ ID NO: 7727 - DNA, 707 bp, Tricoderma reesei
  misc_feature (1)...(707): n = A,T,C or G
cgacgactacgccatcgccggagcgacgtgcgacaacaacaacgtggaacgatgggcagcattcatgaatgccaactatccatccatcatcactgatgagatcccctcgttcaaggcagatcgcaagacgaagctgtacaggggcgttacctcggcaaacacggtgtatgccctgtggatagggacaaacgacctgagctatacaggcatcctcagcgactcgcaagtgaagggaacaaacatcaccacatacatcgactgtctttggaacgtctttgacgcgatccacgctgctggcggtcgccgcttcgtcatcctcaacaataatgctctgcagcttacggggctgtaccgtcccgttgtcagacggaggagcgggcgacaattaagttctggcagaacaagacgctctacaaccagaccgaatacgcccagaagatgctcgagtacacgacttcgtcaaatacaatgatcgactacggngtgccgttncattttgctcgttaagaatcgctggccgggatccaagggtgcggngtattgacatacacagccttatcatnggacatttacaaccaggcccagccggtatttggaccttccnataatgtcgngggctattataagccttgngacgtgaatnggaacaaactgtttgtatgggcccgggacgccttgatttctatttttgggtattatgaagttgg

SEQ ID NO: 7728 - DNA, 704 bp, Tricoderma reesei
  misc_feature (1)...(704): n = A,T,C or G
agcctccctcgccacaatgtctacgtatgtgcctcctccctgaacgccttgcggtacgggccagatgcccgatctcgatttgtttgcagattgtcgtggtcctctcgctgggcagtcgatgaaaaccttttctcaatgaaaagatcgatctgccagctcgatccctcccgaggcgtctccctcagtttttcagaatccgggagcattggattttgcgggctgagagacggcgccatggggtgttggagatgaagaatggcaattttattgcgccttctctctcaaatccattgtcgcacaagggtgattcgcagggtctgaaatgacccgattgcaattgccccgcgatatactctgtcttgggcaagattcttctcttgtctggggtgttgtcggatgagcattccaaaggccttaaccgagcactggttggaatatgcgtgcccgttgtcgctgtcttaacgatcaaattcaagctcgagtcaagccctggttgaagaatgtcncntttcaactccaggtcttgcattcggcgcttttggttncantatgaaaatatggccggacctaccgtactaatcntgattggtngaaaaataagcttccgtccntaccaacgaacaaacattccttggtcccctggaaaccntngttcaagaaaccccaaagaaacccggaaaaaagggttnccncttaaacntgct

SEQ ID NO: 7729 - DNA, 637 bp, Tricoderma reesei
  misc_feature (1)...(637): n = A,T,C or G
tnantcctccccngngctctcgcttctggatccgcaattnactctcctgcgcctgccggtcgtttttacataatctgtctctcacagtatcattggtctaccccctcatcacnaagcgcgtcttctccctcgacatattatcacatacaacagtcaanatggtgtncctcaagtcacttctggtcaccgccaccatggttgccgtctcgatagctaaggactactacatcgatcccgacagtgttcctttgtcgacaagacanaactggtgcanctcggagacgtcgacgtgccccatcatctgccancacaccaccaacaagaagacgctggtcaacgagtgtnatcctaaaacattgagctatggctgtntctgcggtgacaacaagcagccaacatctacgaatcaccctgacgctgccattcttcatctgccaagaatacgtngttcagtgccgaaacaactgnggaggagacaacacttggcctntaactgcgccgaggacaacccttggggtgccctgatcccaagcggacacacnaccggcactggtacttagactacgcngaaagcaccttcctacagtaggccnngacaccatcttcaccggtaccccggangacgcaanagcaacag

SEQ ID NO: 7730 - DNA, 875 bp, Tricoderma reesei
  misc_feature (1)...(875): n = A,T,C or G
gtatactctatcgcgaccttctctgcctttggccatttgcaaagcaagcaaacagctggtcctcggaacaagccttctttcatcgcatccgcctctagtttggaaacttccccttcgcacgtaacccgagcgatccgtcgggttctatcaccatgacttggaccgtctttcaagatgggcgaccctgccgagttccatatgcccgcatggggctggcctctcgtgctcctgaacgccatcatcctgcttcccatttctcttctcgtcaactacacctgttccacattatcctgtcttcgccatcattgaagatgagaaccctcctgcctacgagcccctcgccatgcccgccaacggagatggtcttgatgangaggcggccgntggtctaccgcgaagcctaccgatggcgccggccggacagtgacctcctctcttcgctccattaaccgcttctgacctcgtacggnggattccgagccaacttccgtggattatgtgcgctctacccagtccggctcatcagcatcgtcgnctcatcttctcgtggggacctgtccggcccttggccaactgtggcctcgctggtcatggntaatttggactgctgggttacattggcatttcgcagcctntctnggagggtctggcgccgctgctctttnaagcgcgccttcgatgccacttggaaggcatcgggctntactgggctgngaaccaagtgcaccaanggggtcccctttgntggcggacttattggcttngatgncccgacatggcaacttgacgtcgggcggngcttggacctnttcggacgggaaatgggtattgaacaaagtaccggtanatctcttaaaanaagntgggggtngggn

SEQ ID NO: 7731 - DNA, 849 bp, Tricoderma reesei
  misc_feature (1)...(849): n = A,T,C or G
ntgngaggcgtgctacgccggctttgtccagacgagggacctggaccgcttctttcagctgtcggatcgagacacgtacactgcctacgtgtgcgacttttgccccgcgagcccgcgcttttcgcagtacatgtgcaagtttggcgagatgctggaccgcggcgtcttctcgtacctgtcagactttatcatgacgtttgccggcgtgcctgcttgtcctcggatcaaggggagcggcaaggcgaggtggtggggatatcccgaggccctcttctgccacgagtgcttcgtcgactttgtctatcagacgccgcttggagagtcgctgccgatcaatggcgagtacatggagcaggccacaatctgccagatctggtcgccacggatgcgcgacctgtggctcgaagtctgcagagcaggtgaccccgggtccgaagaatcggagctgcgctggcgcaattcaagacgtgctgcgtgcagaggtttcaggtgtacgaggcgacaatctcccaattgagttgatccggacgatgcaggacattaaaccggcaaacggccttttccacnggatgctgacattccggtacagcggcatggacagcatggcgacgatnttcgggaacngggacnggcacaggcattggaatacagcttgggtggggtcaacacgnctatngggcgcaatcgaaccngactggaatgttttacttaggggcttttcggatccnaatcggacngaggactggtggcggatccncactngaaaatntntggaacnaggttaagaagcctttgcctatgggtgggccatgaatggnngtttaacattttgtttaaccataacccana

SEQ ID NO: 7732 - DNA, 458 bp, Tricoderma reesei
  misc_feature (1)...(458): n = A,T,C or G
tgggccacatgatctccaacatcggccgctacgaataccatgaagactttgccgaagaagctcacaacctgctgcgagaaattgccctcaacgtcgcaaaccccggtctggcccgcgtcattctgctgcagcgattcaatgacagcaacatcgaagccaacatcatctactacttccgcatcttggcggnccactacctnaaggncaacgcanccatctacgacgactttgcggnccgactttggaggcattgncttcgtactgntcccaatcaatcgacattggcaaccgcgagatanagcatntgggcattggcggnctggccaacttgctgntnaagcccatcgacttcgnnctaaagattgnatacctngaccgnagnccgggcagccaagttaaccgctaccgntttccggaagaagncaaccaagnaggagccggccgccttgggccacgct

SEQ ID NO: 7733 - DNA, 699 bp, Tricoderma reesei
  misc_feature (1)...(699): n = A,T,C or G
cgaaaggttcccctcgtggaagctcagagcgcccccaaaggtcaaggcgtacacccacaacctccgcaaccagccggcccagacctttgttcagcagctcaagccctatcatgggcggctcaacaacgacaactggttcaaggtcatggctaggccgtttatcctgtttgcgtaccccgccgtcctctggtccgccgtcatctactcctgctccattggttggctgattgtcatctccgagaacctggctgtcatctaccgtaacccggacggatacaacttcacggctctccagaccggcctcgtctacgtctcgccctttgtcggcggcatccttggcactggcgtggccggtaagatcaagcgacatcattgtccgggccatggctcgtngcaacgggggcatgtatgagccaanagtttcgcctcgtcatggccataccgatcctgatcaccacgtgcatagggctcatgggtttcggatggtctgcggangaaaaggacaagctggattgtccccaccatcttcttcggcatacctcgtttggctgctcctcggctcgacaacgtncatcaccttttgcgttgacaagctaccggcagncgccggcgaaaccttggtgacgctcaactttttaaagaacgtgctccacgggttggngttcatctggtcatttcccaatggctttgccgcggacg

SEQ ID NO: 7734 - DNA, 389 bp, Tricoderma reesei
  misc_feature (1)...(389): n = A,T,C or G
ntcgggaactttttggnccgcgtgagggtattttcttacggaaagggngggttccttcacatgtttcgccaaaactttttacgggcggaacggtattggcngtgccaggttctgttggtgccggtctggctttgccacaaagtcaacgaccgcaagaacgccagtgtgatctgtacggngacggtgcagaaccaaggcaggttttgagntttcacatggntaactgnggaactcctgtttgttggctgcagacacaagtttggatggcacttttgtgcccgtctttgccttgaccgntctacaangaagacagtaattcccggtttaaggcaacggnatggatgtcntgccgtaaaggccgcgtcaagtacggnaaggaatggaccgtc

SEQ ID NO: 7735 - DNA, 799 bp, Tricoderma reesei
  misc_feature (1)...(799): n = A,T,C or G
cgatttnttgcgtacatgaaggaatgtcacttgacgcatgcgccatccgccgctctacctttgtctctgctgccgcaagacgattacactgcggccgagatgctccagtactactcgaagcgcccagaggaccgccagacgaagcctgtccctgatgtgaaccccgtcaaccccaagctcattgacctggcgtattccaactccctcgtcctgcagctcatcattgcccaaagggtcaatcaccgcaggtgtcatccgccatgttgccgaccggcgaaagggctgaaggcttctacgctgctgcattgccgagttcgggccaatgattgacaagctacctggcggggaacgagcaggatatgcttccgctcactntggcaaagcctggtcatttctctnaccgagagggcgcggcttgacaaacgtggtcaagctcacaaccattccaccgcaccatgggtatcttgaagacactnttgacccttccccacaaagcagatgtgtaaacaggtccgcctatcttgctggagtattacatgcatgctgcttgctttgcatgtgttgcaccgatgtcaccaaggcggagtcaatttcatttatgagcgagnacttcgaaacgccgtcgacaactanttcaagcgaaatatataggcaagctntgngggaactggctgncgatatgggtggcgacaaaacatnttttaacttggcattaaaatgcggncgttgncgataccattnaacgccccggggggcggncatcaccggttattacccnaccactttgtacctttgggca

SEQ ID NO: 7736 - DNA, 478 bp, Tricoderma reesei
  misc_feature (1)...(478): n = A,T,C or G
ctgtggctcacgatcctgtacctcgacatcaaggtggccatgtgtaccggaatgccgcccctcacacggccggacgagctcggcaccctcgagaagattcccgaatggggtccgccggacagtctccagatggtgctgtaccagtcgctgccgaccgtgctggccgtcatggcgcagatcaattccaacaaggagcagatctcgtaccccgacgtgctgcgatacaatgcccagctgcgggagctcatgagccacgcccagcgggtctgtaccggacaagctgcagcgtgtcacggtcgacatnttcttgcggcggtgcctcatggtgctgcatcgttcctttgcctgcacccagagggcccgtatgttcccgagtcgnctggtcgtcctggaatgcttgttttgcctgtggnnataccgcagatngggcacgacccgatctggctgactngtcgncggcttngctacttttccccct

SEQ ID NO: 7737 - DNA, 612 bp, Tricoderma reesei
  misc_feature (1)...(612): n = A,T,C or G
ctggagctcagcctacaagccgtggaaaagctgccgaaccagcagcccatttccgatgagctccccctgagcctcgatatctcccctgcctcccttgaattcgttgaacgagtgattgatggcgagctgcagcgccaccgcgccattgtccacgtcgacaacttgcgcaagaggcagtccgaggctgtcgaatacgaaagcgaccttcccctcgtggagaagctgcaagagtatcctgtcggtggggctgatctcaaccgcatcgtggaattccccccgcgagaggcagtgatccccatcaagcccatcttcctcgatgtggcctggaactacatccactaccccggcaaggaggttcaggcgggcagccatcaggcgggcgaggttgccatgaggccgagaaacctgctcaaaaggctaaaaagaagctggttcggctttgggaggtagaatagtgtcaattcatccgcatgagttgcacactgcaacagaatggagccagaagaagaaaagaacccctgattgcaatgagcttagtcttaccgcaggcatgcttgccatatcttcatctactgatgactattacctacctaaatgactgncgactttttg

SEQ ID NO: 7738 - DNA, 704 bp, Tricoderma reesei
  misc_feature (1)...(704): n = A,T,C or G
ctgaccgagaccaggcagcctgtcgaaagattccccccccccccccccccctctgattcccggtttgctcttctcggatcaaaggcagccagccattgacccgggcttatccgacagttgcagagagggaaagcagaaaggcatcaaatctcgttcatggaaccggctgatgctcaactcgtatgttgcaaatggcctgagcgcaaccgagtcggccattgtcgcagcttgactgcaatttcgccccgttgaagaagccggccctcagggttctcttttcttcttcttgtcgttgctttctccacaagcatgtgccgagttttgcgtgtctntcctgctgtgactcgagctgcgcgtttggcgatatccttgtttgatgccagtcgccgccgttggtggaaccgtgtcaaaggggctgctgctggccttgattgatgctcaccgcctgcatctntgcgttgccttcgcatcaatgctgcaaatgcagctgcggatgcaaaatgcttgaagccaaaactgatcaaccactcggtccgccatgacgcaggtttttgcccgtctgcgcccttcaccacttgactggcagtcgtttggaataacacgggcggggtattcaggtnttccgacgntcggaacttggcagattcaacngcngcaaaanccgatttnaaagaccnaagnaaaagaccccattaaacttccac

SEQ ID NO: 7739 - DNA, 590 bp, Tricoderma reesei
  misc_feature (1)...(590): n = A,T,C or G
gctgcgtactaccagaaatacccggaggatgtcgaggttctgcgccagattgctgcttacatcgaaaaggagggcggggagcagggccttcctttgcctggaggaggcttcctgacggtgcctcgtctgttgactataggcattgcccttggattccacggaggcatcgatcagatccatgctgtactgctccaactcaaggcctccctcgaccaagctcgggcttcctcacacgggcctcccttagccctcctcgaatcattcaccccctttgacacaaaccccatctacgcccgtcctcaagaggcgctctactgcnacggacccggcagcgtcttcaactggggccgcctaccgcgtcgnaaggccctgtccagttcttctggctcgctagcggcaacacnggcgcttnctcctccgtgccagtcgaccaacctctgcttttcgncggcgaaanggtcttcccttgcactttgagacgtatccgaacttgatcccctgccggccgttgctgaaccggtggctactgcgtcggaatggccccgcctggatgatgtcaaccattgcgcaagaatganggcctgttatgc

SEQ ID NO: 7740 - DNA, 833 bp, Tricoderma reesei
  misc_feature (1)...(833): n = A,T,C or G
cagaggaaaagggatcagctttcattatctttcaatcttaccttgtacaacatagaggtgccgctcaacagctctcataacatctcgaatcaagcaagaatcgagttctcccccctcagctccagttgaaactcataggtattactctctcacgcacgcacaggcggagctgcgataaaacctacaacacctctctccatcatggcaaccgaagtgtcccacggccgcggcggcgcgggcaacattgacgtggacgatacgaaatatgtcgacggcgaggtggtgcgcaccggaatcatgggcagccatggtgatggcgcattcagcgctggccgaggaggtgccggcaatatcgccgacgtagggaccacgtcgaagcatcgcaacgatacngacgttgtccccgaagctgctgttcgcgtgagccaagatgggcaaggataccacacaaggccgcggcggcgcaagcaacgagcatcgtgttgacgacccggctcatgcaaaagccttcggctgtggcgccggtcgggctggcggacaagctcaagtccaagttgtttggcgcattcaaacactaataggcgactttactatcggggattgcgaaatcgttgcggccagaaaggagagaaaaacaaagcattgtcggtaggggtgtttgacnatgttgggttatggattccgccagtcccccttggtggaatacacatatgatatccccgtcgttgagtttcaatttggcccacttgagttatattgntattgcgaaggctgncattccaaggggatgacccnaattntaagaagcnggaataaatttcttgagtcaaaaa

SEQ ID NO: 7741 - DNA, 673 bp, Tricoderma reesei
  misc_feature (1)...(673): n = A,T,C or G
ggacattgaactgctcatattgtcttcttcaacatactcacacactcgactcgaagaaaagaacaccgtcatgagctcctctctaccgccctttgcgccgttcccaaaggcttcgtggcggcagcacatctccccagatgagtgggaagctctatcagaagcttggatcgccctctcacaagcctatctcgacctggacgatgccgcattcaaaaaggaggccacagacgacagctctctaacgacatttgtatcgacctttgcagaggaggcggcagcagcagagtccgatgcaaagacaacaacaatagcgtcatcatccccccggctcctcaagacgatattccgcctcgcatcgcgcatcctcacagcctcgccccctcctcgtctcctagacgcccgcttnctcgccggactatgccggatattccaaagaatcacacaagcgcctctgctggcgcggntctttccaacagccacgccggccgccgntgtcgaatcctttctgctcttcctcaagaagctctcatnccgcanctcgacgcccgncagaaagggggatctcaaagctcgtcgaagcggggagctnacgccagcttgaccccgntgntgacgccttgcccgacgcgtgcatgctggtgntcgcgggtttcgacttcttcnacnggctggg

SEQ ID NO: 7742 - DNA, 396 bp, Tricoderma reesei
  misc_feature (1)...(396): n = A,T,C or G
ngntcggcacgaggcacaaacgctcttgtcacgtcttccaccatcagcctctcgacctgcttcaggcatcaagcatgtctggccctcccgcccaagaggcccctgccgcgctctcgatccagccactccagccgccgccgtctccccagactcatcgtgccttgcgacggcttcagtctgctcacgccctgggagcccgagctgcccagcaggcgacnctgagctngcatgcagcgccggggagcgccctctgtcgccgacccggaacgcggtngatgccatcaatgctatngccaaacgctggngggcagttccnaatcccagccacgtcgccaacgcgcatctagacgtcgggncanacgcgacgggtgcggtntcgagggncgtgccaacagc

SEQ ID NO: 7743 - DNA, 649 bp, Tricoderma reesei
  misc_feature (1)...(649): n = A,T,C or G
gctccatgccatccgacgcgacagacgagcagaccgcgataggtctgacgccgagctggcctatggcggtcgccgtatatcgctcacgttcaggcacattggcacgtttctggaccgtgacgagaccatcatctggggccagggagcgaccggcaagactcgcgacgctgcgcacgccatcaagaacggccagagctccgacgccgtaaacatgatccgggcatttggcatggaaaaccatgcgtccgactttgactgggacgcccattacggcggcggctttgacgtgctacacattagcaactcgccgaggttctttgcctcggcggatcccgtggtcaacatgcggattgtgctcatgctgaatgaattcggcatcaagttcgcaaggggagcatggcctnttgtgcaaacgcccacagnaacagtnaaaggcagcccgtcaacgttctggtcnccggncatnaagttcgtcganaaccgacgctgncccgatccgtngtncagggcganatggccatcatgctggatctgactntcggtatggccccggncgcaattaccgaggcaggctcnggtttaanacaatttaaagaagcttggcantcttttacagccagctgcagnaagggcttaatctntttgccca

SEQ ID NO: 7744 - DNA, 330 bp, Tricoderma reesei
  misc_feature (1)...(330): n = A,T,C or G
nttaggcgcgattcgcacgagcgaattcagcgtcaggtcgaggcaaacgtcgagagcgacatcacctgcgagatttccctctctgggcttgtgacggcgttggttccagggcggttcgatggcagcaccgnacccgagaccctatacattgagcatntccgcatacagtctcgcaagtcgaatggcgtctggttcgncagtgccgccacggtgtatggcacttntagccagaccattctctggaactacaagatcccggacgacatcctgtcgttctccagaaaggaaacagtgccgtgnggcgttctcgtgctgttctgcattgnagac

SEQ ID NO: 7745 - DNA, 420 bp, Tricoderma reesei
  misc_feature (1)...(420): n = A,T,C or G
cacgattacggcttgggaagggcacgcaaatcgaagatgggcgatcctggcgctgtgccccggctcccgtgcgggggccaatgggaagctgccagtgtcttctctggcgttctctgtcccctagctggcgtgtcccagcggtcgccgagtggggctcagggtcctgctgcanctgcagggtcttggttggcgagtcggcggcgcttgacgtaatttgacctcatgccacctccacccgctgacatcancccccnggtcgcccgtgcncttgatttnttcgtcnaacctttgacgcgcctggcttgcttnaatgacagcaantgaacnaanagcccctnttgcnatgcttgnngcgtttccnatgatgccgccncgtcncaagntgaaaacnaaaaccacaccgngaaacgtccccccttc

SEQ ID NO: 7746 - DNA, 478 bp, Tricoderma reesei
  misc_feature (1)...(478): n = A,T,C or G
tcatggacccccttgccttatcggccccgaacgacctctcctctcactggcagcactcatgttcggtcacggtccgctgctagcattggcgccgcgcccatgggccgcacccagtccatgcctggcgtcactggctccggtcatctgctctactctccccagtttcgcccagccagcccggcgcagtcgccgagccgagtacgcacgccgcggaagccagtggacgagtcgtttcccatgacgtctcctgtacgaacgtcaagttcttgaccacgatcgagtgcctgccgacaggagcggctctcctgtctgggtgtttagccaatggaaccttgactcgggcccgtcgaacctcgtcgccgattaggaattacgcccagtcgagcaccggctctnttccaacttggccaccacaccaacatcgagctcgtcgtttttntacagaagcgtacgaccccttntntagcaagntatgggg

SEQ ID NO: 7747 - DNA, 672 bp, Tricoderma reesei
  misc_feature (1)...(672): n = A,T,C or G
ggcttctgcttcccgttcatcaagtcgaggcatgtccgggcgcagctggcggtttgcttcgtggctgccgtgttcctgttctcgctgctggcagtgtgtaagtggatatcggatatggacattacgacttgtcttggtatatgtttgctgacattggccttagacttgggcttgaccctgacaaaacatgtcgtcattggcgagctgaacatcatgttgctcatgatcatccttctcgcagcccgtcttcttctgctacaccctcatccggctgtggctgatcattcacccgcggcgacccgccagatatcccccgagccgtcgacccgcgcggatatgccgtccccggacccccatacgggtggtgatggccaagacgaggaggctgcgggcgctgaaaacgagacaatgacgatgaacccgctgctacggactttggcnggagaatgtgccctggacccaaccgcttnttntggcaacgtaacgatgccggcgagcccgcccttcgaaaacggaaaccngaccgaaggccgccgcttaccctttgatgacggngtattctatgtgggtgatgcngggcttcgtctggtgcttcatcgtagatggggaacacaacccgtacatccttngaacngggtcggcttggncagcccccccccactngaccaatta

SEQ ID NO: 7748 - DNA, 109 bp, Tricoderma reesei
  misc_feature (1)...(109): n = A,T,C or G
ngagattacctgtattggactacnacaccatgtattnttgtntgggttnacggcgggatggngctanactgtgtctcattttagatttacacgaattgctacnaatgta

SEQ ID NO: 7749 - DNA, 758 bp, Tricoderma reesei
  misc_feature (1)...(758): n = A,T,C or G
ncgnaatctggntttttggncgtggcncaaattcttggaattcanncacttccgggtncttcnaccccgaaatggtcttacaaaataaacaattggaccnggcgcccttttttcttcccgctttggcccactttngggcttcccgaacaaggaaccaaattccggcccaagggccttanttccttggaacaaggaaaaaacccgggtngggggtggggcnaaaccggttttccaaagttccccttggccanttanccaaaaggnaaccaattggttggcccccaaggccaaaaaaattcccccaaaattatttctttcnaaaaccccaaggaaaaacctttcaaagaaatgggttccttnaattccttttgggggcntttatttggttttggggntttnggggggggttggccccccgggaattccaantttttgggaataaggccaaccggttaattggttccccttggaaccggggaaaaaacaaccccggaacttggggcaaggtggggtnaaaccttcaatngggaaccgggaaccancaattncctttngggtcaaaggctttcggtggttcttcggcnaaggaaaaaggtaggcaacttnttgaagccttgaaatggcannaaagcccttcggccaaacgttttggtattcttcgctattcaaaacattaagttggcntactcttatgangnttgtctggttctcgatttcagctttatatagtttatncaaacagtcattattcccttgng

SEQ ID NO: 7750 - DNA, 189 bp, Tricoderma reesei
  misc_feature (1)...(189): n = A,T,C or G
nctttaanaacccccaagaaattggntgtggttgaccctnnggacccccgggggntttttnaaaccttnattggtttccaaanatngccaatgggggccccnattanggaaanccttnccccngggttccttgggttnccccagganttggtttaagggggccananttccttnaaacttttttgcnna

SEQ ID NO: 7751 - DNA, 381 bp, Tricoderma reesei
  misc_feature (1)...(381): n = A,T,C or G
ncctggtccaagtcccnccatcaacaatngtagccctcatgtgcccattatcatccgcgacagcagttcccganacagtccttttnacctgtgccaatcctccctccggnttccgaaatccaaacctgcccagaacctgccgcccaaagtaccaacccatctcccgatttaccggccccagcatgggagaaagcatttgggctcaacccacgtccaacaaaggctagagggcctttaccatgaatagtaggagcgctcgccttgcgtacaantgctcaaaaatgtcccgcacaaaaaggccgccgtcaacatccattntggnttggaacccgatcactcttgaatcttcccgtaacaggagtnccggggcttcaaatgctt

SEQ ID NO: 7752 - DNA, 656 bp, Tricoderma reesei
ctgggtaacaagtattccattggcaccttcaatttccagccattcttttacctgctctcctgaagcaacggacaatgccacccttctggcagctcattggtgaaggactggcgcgcgctcaagaagaggctgccaggcacatcaccccagagaacatcaacatcgccgtccaggccgttcgagatggcgtcgggcacgccgtggagcaggtgaaccagcatgtaacgccggaaaacattgaacgtggtgctcaaatagttcggagcggtattgatatagccgttgaacaggctcagaggcacgtcactgctgagaatatcaaccgtggcgctcagatcgctggcgaaggcgtccgatttgctacagaacaaatccgtcaacacgtcactcccgagaacatcaaccgcggcgcccagatcgcgggcgaaggcgtccgatttgctcagaacaaatccgtcaacacgtcaaccaagagaacatcaacccgtggtgtcgagattgcccgaggtggtattgatacttgcagcgcagcacatccgtgaacacgccacccccgagaacttttaacacgcaacggagaaactgcgcgaaaacgttggagaaatagtgcaagggcccgtcggtcagaaggttgcacccgtggtcgaggaaaacaa

SEQ ID NO: 7753 - DNA, 700 bp, Tricoderma reesei
  misc_feature (1)...(700): n = A,T,C or G
tcgaagcggaagcattagcggtagactccggagcctacagatcaaggcccccagggtgtatgagaagatggaggactcgctcaccgcggtcgaggaggtcgagcagcaggtgtcggagctcagccggcgaaagacgggaaccgccgcggcgttccaggactggatcgaagagcttcaggagatggccaatgtccccgagtcgcagccgcggtcatcgctcctcgatccaaccgcgcctcgtcaagccgttccgcatgtcatcaccgagaaatacctggccgacctgacgcggaaactcgtgcgcgcacggcattcacgatctcaatatgttggggagtggacgcggttggtgcacgaggccgccaagcttcagatgatcctggactcggtcgccttcaagaagctcgactttggcgacgtctcgcctcacgccggcttctgggacagggtgaagatcttgacgcccgtattcgcgatacctctgctactactaccgtctttccatatgtgcgaatggggtttcggtgcgcttttggggtttccctctgcttgcatcgtctnggtcggaaatcgcaagtttccttccccaagctgnccattatccgtgtcagcgttgtccaccactgggtggggcgacaanggccangtngggtttggaggacaggtatcggggcctttggatctgntacattgtgccctg

SEQ ID NO: 7754 - DNA, 613 bp, Tricoderma reesei
  misc_feature (1)...(613): n = A,T,C or G
cccggcagtgtcgttttccctcagaacaccgaagtcggacagccttctctggttggccctgttgtcgaggctgcctaccctaccgcctccagcagtcttcagacgctcgtcaagcccgctacttcagtcggtgtcccccagggttcccctgctggaagtaagtgttgcccctgctcctcagcaagccaacggccccggccggtcctccagctaccctaccggtggttccggcaacgcgtcgccttctggaagctggagcggcgtgcctgttgggccctcttcggttcctggcattcccgaagcaaacgctgcctccgtgatgaagtgccagcttgtttggcctggtcattgngatggccgctcaggtttttgttctataagggagctcgcgctgnaaaactagacatgttcaatcttgtgcattttacggatgggttttccggcagggccatttttcttctcagacattcttactctaaacaaagtcctctgagttctgtatttttggactgatgaggcacttctttattacatactttattttctttatgncgaaaccggctggacatgtgtaaanacttgctgnataccttaacttatgacgatgatttcc

SEQ ID NO: 7755 - DNA, 471 bp, Tricoderma reesei
  misc_feature (1)...(471): n = A,T,C or G
aatcatatccgacgtgtttctcaccatggcctctcagacggcatctctgacggcatctcggaaaccccgtgtaagccgggacactggcttcccggagccattcgatcaattcagcaatactactctcccacatccagatgccgacctctcaccaaacgcttgtataacacacgatgacctgattggcgactatgctctcaagagaaagcgaatgtccttcttatcccgaaacaagaacaggcgaaccctcacccatggaagccttggcgctcaaagcggcctcgtcaacaagtgtcatgtccctatcgctgtcccggctccagcagnagcagnccttcaagtagtcgggtgaagcagcccctaggttgacgagtcctttgacgggcagnttncattcaaaatgcggcagcgagagcgcagaatcgancaagaaagaaggacgagaccccaccggtcctcgcttggatagca

SEQ ID NO: 7756 - DNA, 849 bp, Tricoderma reesei
  misc_feature (1)...(849): n = A,T,C or G
acttcatcaactgctcttggaatcatattgatcccaccaacaccaaacagccaccaccatgtctgaacctctcaccaaggtcgattccgccgtccaaggcctgtcatcatcgccgccgaaagagaagggccataggagaacaagctctagcgcggctggtgtcatgaccattgcggaaatcaacgaaagcaacgcgcccttggatctggcgctggagacacagcagactgcttggaaaatcaaccagcggccaaaggatcttgacaatgatcagctgctacagatccccctcaccaagcctncgatcaagagcataacgctcaagttcccccatggcaaagaggtcgtggctcgcaacatgaagggcctgacaataggcgacgcactgtcggccatttacaaggcgaacaagaaccgagtaagtgtcgtcgtcgcattatccctctcccgagacggctggctaacatgcctgcaggctgatgatgagcttgacaacccatacctcaagggcttcgcatgggaacgaggcgaaaactactttgaagtgcaccttcagagccagtcggcgacgggctcgtnaagcggcggcggcggtggcaagaagaagaagaagaacaanggatgcngaccaatnaatgacccatcacccatcctaatgnctggtcaataagttccttcaatggttttggttgggcttcccggttccggtgcgagtcgcncccggatattgcaactagatggtgtnggtcggggcatattggcgattgctggaaacattgccaatgtctggaaagcttttgnaacggagnggtctgnccttttaatggataacttggactntttnaagaa

SEQ ID NO: 7757 - DNA, 868 bp, Tricoderma reesei
  misc_feature (1)...(868): n = A,T,C or G
ngcggcatccaccccatcatgatgaagattgtaaagcatcgagtgatatcggtcacggcncggtattctntggggcctgatcgtatgccgggtcatctggcccatttcggcccgcaaaaagttcaaggagggcgtctcgatgctgtaccttcagatgggcctcatttggaggcgaggtcccctcgctatcttgcttcgtagcgactgttccgagagctacctcaaatccggggagcaggttgccatgcagcgatatgccaaccgactggagagcctccggcagtcggctgcgtccgagttcgagctccgtgggccgttccctatggagacgtatggtcgcatcatgcggtgtacgaaccggatattggacagtttctacgccatgagccttgtagcgcaccggaacaggaatctnaacccgggcgagcgagcgctgntggagtacacggcaacagagcgggcccgttttgtgcgaccgcatatgccacgtcttccaggtgctcgcagctcgatgatgttggagtaccctnttgaccgatgcggtcccanccgtcaccggcatncgtgatcngctgntcgcaagattttncagttccnaangagcaccccgttgaaccatgaaaaaccttggntatgccggtgaanggagaatcgaaaatggcgaaagcaacccgcngcgatgccngttgntgttgtangaaacaatggtgacaatcacgtcanggaagtcnnggttgaanaanaaggatattccgttgatctatgcatacacccttatgaccggccncgttgcccacgganttgaaaaatgcccaaanaaaaaatggatntttttttggnggttttnaacnaaaaaatacccgttcnt

SEQ ID NO: 7758 - DNA, 103 bp, Tricoderma reesei
  misc_feature (1)...(103): n = A,T,C or G
naaggaggcgggacgaccggcncttcaagttcttaaaggntgattcgcgaatgccatttanttgggcantacccaccncgatggcaaggatttggcaaaccgg

SEQ ID NO: 7759 - DNA, 305 bp, Tricoderma reesei
  misc_feature (1)...(305): n = A,T,C or G
acgtcctcgacaccaccgcccggtcgccccgnaaagggccttcgcgtccgcctcgagggtcccgcccccgtctcctcctcctcctcctncgcaacagcagcagcaggacaacacccntccagccacaacgcccacaacgccctcaanacctttgagtccntcacaaacnacnacggccgcgtnaccgtntggntgccntacanttccnagacgtccgccggagaggtgcccctctacaccctcnaggacgtgctcggcgccgtcaaggggccttcnccttgaccttgcgtttgacaccgccggtt

SEQ ID NO: 7760 - DNA, 334 bp, Tricoderma reesei
  misc_feature (1)...(334): n = A,T,C or G
ggggggaangnccggccccggtgggccccggcnccggtnaccctttcaatggggggcccgncggcttggggttggccccaattcaaccgaaccggggttcggaacttggggcttggccgggcaaccccgnataaccgccctccctttcaaaacccgggcttcttaaccgtcaaaagggtggcttcgggcggcccttcaatgaaggggaagaagcgaaataacttcnggcctgggaaatgggcggttcaatcttttaacttcntcgggcgncttgaatnaccntttattttttcccnaagnacgttggcgtaataancgtcttgnttttaagttg

SEQ ID NO: 7761 - DNA, 547 bp, Tricoderma reesei
  misc_feature (1)...(547): n = A,T,C or G
ntgnacggcgacgacgacagangcgngacgtctttcttcangactcgcccatccgncagcgccgccggcttcacnattcgcatcggggttcggtgcgattcaccaccagcttcgcccatcacgatgaatgtgctgctctcgccgcagttgccagttttccctcaccagcacgaangcccgcatctctcccagcgaaatctctctctcttcacaacatgagcagccgaaaacgaaangccgncgactatggcgacgaaagcatgtcacccatgaagctcgccccnccgtatcctctcnacctctcattcgtccgtcgaaaaangtttngatcaaaatgacttgatcnngacgaccgctgccttcgtcacngcctttctggaaacactnaacaccgatcaaactccggtctggtcttggaacgcatttgcnaagcgacatcccngacattggccangaaggcggtttccggggcgcccgggccangcgttgctcagccatgaatgtgntcagtcatatcagggacaaagcttnacgccgccgccctcgt

SEQ ID NO: 7762 - DNA, 336 bp, Tricoderma reesei
  misc_feature (1)...(336): n = A,T,C or G
tcgtccaggaggccatgggccactgcgccgtggcctctgcccccagcaagtgcaccaggcgcgccgtcgccgactacttcgagtccggcgtcatcccctntgacctgtcgccctgcaacgtcgagtgccgcccctgggacacttnttgcccggccacggacgacgctgccctncacaacaatgatgacgagatggaggccatggcctnctggttcaacagagacgangctgtttggcacaggaaatcacctcttggattactttagccctgtctccttcgttgaactgtttcgcaacttggcgctgctagcatacatgcatgtacatctgaccgcg

SEQ ID NO: 7763 - DNA, 732 bp, Tricoderma reesei
  misc_feature (1)...(732): n = A,T,C or G
cgcnngaggaagaggacacgttcctggccctgcaagccgccattgctgcgacggcggagaatcctgctgcattcgtggcaccgagacaccagccgagtagcggcgctttttcactcattaagggtcgagctgttcccaacgggcggccgaacatcttcccttctaccatgcagcctcaaacgcaggatccgatcggcaagctccaaagggaggatgccctaagctacatcaaccaatatgtgttgccgaggctgagtcttggggctacaagtatgggtttcccgaagggagcttcttctactcgtgactcagcgagcctcaactctctggcgccctacttctacggccctgatgctgccgctggtgtaggcatttacagctcgcagaaagcgctcgggccatacaagactttgccgctccgggcatgtcgctggacgagattggtaaaggagcggcagcagttcgattggcaacatgccgctgatgagccgttgaagatgccgaagcagctnctgacagccgccaagaaanagaccgagaaactcgaaaagggtctgaacatggttatcaagcggaatcgcaggctcttgctcngggcttgatgttgccttcggcccttggggtggataagctggtcgctgaatccatgatgacgcccacattggacaaaaaagtcaatttacaaaattagatgnattantatatgtataaatagcagggcgnaatctcctt

SEQ ID NO: 7764 - DNA, 627 bp, Tricoderma reesei
  misc_feature (1)...(627): n = A,T,C or G
caactgccacctctcaggctgccggtggaatgctgtcaaagcactcccgaggtggggtctggagcctggagcacttgtcaaggccaagatatctcctctaattccccgccagcggctgcactggatactgcaaaagggacaccccaagccacccagaaaggctccgaaactggggcggttcatggctccagacagtgcaancgtggggggttttcgtgggtctctgtcattgntcatcccctcgatagactcttgtggancgcttccacaatctatgccatgcaggtaaccgatggaagggctgcgtacccaaaggaattcatgccantacggnattccgtctgccggtgctcattgccggctttctgtggcatctnatggtgcctncaaaggaaaaagantcccctctgcttcgggcctgttctatctgcatacgcntacgtaccgggagcatgacacgancatntacccctttantttgcgcctntggccccaaanttattcggaatgtgggctttgctacccancgggtatnaattatttgggtcaacgttcttctaancaataccaaagcgtgggcccgttatccnccacgttacaattactttgacnaaccgntttattggt

SEQ ID NO: 7765 - DNA, 407 bp, Tricoderma reesei
  misc_feature (1)...(407): n = A,T,C or G
gaggacgcagatacgccgtggttcctggatgtcgaacccccccgacgtgcgtcgctacaacacattgcatcgctgccaaaagtgcccgaagatgcgccccctctcctcgagccgatgatgaagtacatatacgaagacatgggcctagacgagctgtccatgctggacctccgcgaactggacccgncggcagcactngggcccaacctnatcatgatcttnggaacggcacgaagcgagaggcacttgcacatttntgcnggccgcttcgtaccgatggctgcgcaagaaccaccaagttggagctcgggcggatgggctnattgggcccggagagcttaagaacgaanctngtcaaggntgaggaaanaagggccaagatncttgggaacccaacacaattgatt

SEQ ID NO: 7766 - DNA, 502 bp, Tricoderma reesei
  misc_feature (1)...(502): n = A,T,C or G
ggcagcgcagtgttgtatcgcgactttgaaaagacaaccaagaagcaggcggccaagtttgtgggcggctgcctactcaccttctttggcgtctttctcatcacctctggcagnagaccagncgtgacgacagactgacgaggaagatgggctggctcgaggccgatgngcatcgaaagagacaattgggctgacgcagcacagacggcggcgcctcatcctctgcgcttcctcaagcacggcgtgagcaagcggcgccccagcctaccgcctccaaagacaccatcttcgacgatctagcaataatgtcgacgaagtcagtttttgccgacgcgctcaaggtcggacttcagccacagcgccgtcgagccccatcgaccatgatttcaaccggcaaactccccgcacacttaaccggcgaacnaaacgcatgtgctgggtaacaaacccatggnaagggcctntgggtgagccaagatcttccnnggggggctcggacaat

SEQ ID NO: 7767 - DNA, 679 bp, Tricoderma reesei
  misc_feature (1)...(679): n = A,T,C or G
tcgcccacttttcagtcgacttcttgattcatacaactcttgatcagctcacattcgataccgctcgctaccattcagagaatctgtcgccatggcctcccaagaaactcccgaaatggcacagaaaacggctcagacgaccacggttcctgtggcgcccgctcccgcgcactctcttctcaagagctggcggctgccggataccagccttactaccaagcttatccaggccaaccaactgttgcgcctactccggccgagtcaaccaagggtgcctacacgagactcggattccacggcgtcgtcgttgtcttgggcgccatcngcctgggcgtgtcttttgtcgtcttctcgggggggatgagggctacgggattggtgcttgccgcagctnctggtgccgctgnctgtttccttggagtctcgcanaaactaatcaccagaacggtgcgtaaatggaaagccggcattcacccgggcgcgcacgtgggcatntgccttatcctctggcttttgacggncattatgggcngcagccttgtcngcgtttgtcgccctgaacgacgtttnggacccgggacgaggagaactgnatngtcaaacacgtacgaacggtaacggnaaccttgacacgtaccnacnagtgcgangactactacgngcactacccgcngggcaa

SEQ ID NO: 7768 - DNA, 579 bp, Tricoderma reesei
  misc_feature (1)...(579): n = A,T,C or G
ctgtgagtcggctcagctcatcccgacagtggaatccatccacctaactcattttctctaattgctttctccccagcctctctcttattctttcattgagcaataagttggatagatgggtcggggaggtgaggtgcggtcgagcgcgtgacttgggccaaagtgcccatcgcatcgatccttttgtataccggcattcgccgttgggctttctttttctggtcacgaaccacgatatatgtggacagcagcaggggagctggactggactatgctaatcatcttgactatgcggatacactcgaatgaagggcagggataaaacggacgtacggagtacgaagtggatttcttcttttcattattccttccttttttttcttcatctttcctctagtcttttcttcatgctccttttgctctatctttgctttancctctccattgagttcaangcaacggggagcaaggagccagcgatggcattctctttgtctacagcatgtgtttgaaatacgtatngggtaatgcnctgcttcgtgtcaataaatctgcngantactatcaatatatatacaa

SEQ ID NO: 7769 - DNA, 800 bp, Tricoderma reesei
  misc_feature (1)...(800): n = A,T,C or G
caaggcngncccacagagacaggagcgtcaaccgctcgtcgtaccaacagcaccaaccgctctcatccaggcgacaactgcggatcccgtgagattctgctgtcactgctgctgctaccttagccaggacatccctcttcgcgcggctacgagattagctcccgagatcaagctagcttatagacctgcgcattggtggccccgccctgcaatcaacgaaacccgaacagagccatgcctgcaactgcttctcaacaaacggttctcccgctcgtgattgggtctttccgagttgacgcagagaaagggccggcccagctaaatagcccgnaggctcgcaacttgcgctcttctgtttcttacactcattgaaccctcctactgtcactgtcctacaacttcctgcaaccccggcttgactcggacgatcctnactccgtcagcatgagttcagccgccgacgtctcggccggagacgctgagctgcggaccgncatgcttacgagcaatcaccagacgcaagggnaacaccaaccccaagttntgnggggccaattgaatcgctacggttccangatgccaagatggaggattgataagccaaananacttttggccgnacaccggatggnacaatattcgtgngccgactacncacganatgggttcgcaagttcttgacccgcgaaggcnaaaaactttcggacctggtgggctactattctacattgnnaatttaacnacatntgtttggcggtggggacaancnacttgggttcgcggccttttcttttttggaa

SEQ ID NO: 7770 - DNA, 554 bp, Tricoderma reesei
ctcggtaccactttgttcgccaggagagcctcgtggggtccgcgtccgtgcacgctcatccgcacaggggcagcgagagcgacgcctccgtcgtggcgtcctcgtcgtcgtcgtcgtcggcgagcgaagaggccaagaagctgcagcaccgcgcacgggagcagcgcgtcccaaaggttgcgcccgataaagaaacaaccgccatcaagaagagcgaggacgaagcccgccctgtcgagaagctgaaaggagtaggtgtccggagaggaagcggtccttctggtgctgtcactcaagcagtcagcgtcgacggtgtacgagatgagtgagggcggcgttttgtatgcaacttcattggagcattgcttgtcacatgggcgtcacttgttattcttctaatacctcttgttggatccttggcttgctcgttaactttcaaggcgtaacttttggattgggggaaccccatatgccatctggtccatggcgacgttgaaacttggaaaaatataccctacctatatagtaatacccaaacaaattatcttcatgcc

SEQ ID NO: 7771 - DNA, 419 bp, Tricoderma reesei
  misc_feature (1)...(419): n = A,T,C or G
atgtgcagcatcaaactcccgtcaagcccggccagccctccgtcaacggtttctcgaccccgcaaaccccacagcttcatcagcaaccgaatgccggtcctggtcacaatcggaatagcctctcgcgcagcatggatcaagccgggccaaatgacttctcaataccttccccggctcactcgagacccggaagcattgccttgggccccgtcgacggcccgacgatgggtgtnatgagtgtcgagcagcagatgccccagctttccccgagatcagaggaatacagtccattgcgcacganagcttttccacgtattggggggagttcgaccttcattgccggcgaaactttgttggggcgccantaagcttgggagccgggnggaaagcccaacttggttcccggcccggnggaaacg

SEQ ID NO: 7772 - DNA, 648 bp, Tricoderma reesei
  misc_feature (1)...(648): n = A,T,C or G
actgttggtcgataccgatggctttctggccaatttccgtggcctcacctgcgctatccttcaaggagtcgtgactgcgtttccggtcgccatagtcaaccgttattggcgctggggaggcagcttctttgtgcgactccctcctgcgctggcaatggttcagttcagtactttatggctgcatctcatcatcgctcaacccagtaagcgatcattctggagacgcttgcccccgtttagacgcacctacgaggcaacatggagaagccgtcgtcgttcactgggcttctgtggaagtgactcgatggctgccctattggctggctacttatctgggcattgactggccgcgattcaatctcctcatgcccgacaacattacgctttcaatatccaaacaagaactggagacatctactgtactcgaaatacgctctcgtatcttnggtaccgcatcggctccatctgcctcgttgtacccagccaaagtcgttctgatgccatttcaagcgtcccttcttccggttgaagatcgcaccattatcccttcgacagatcctttaatgggaaaagantggcctacaccgggggcggccgaggtattncacaatgttgacgcgtctttacttttacctgggcaagctggaa

SEQ ID NO: 7773 - DNA, 877 bp, Tricoderma reesei
  misc_feature (1)...(877): n = A,T,C or G
tctgaaattgcagcatttcttgctctcctctcaatcccccatgtttcccacctgaaaatcctcggcaggtttcacatgccgcttggccgttccagaacctccccgggccgccgataatccggtcgcagcccaccagcgccaatcacccgtggggccctttgacggcaggggtctcgaattggagacgtgtccagctgctgcttacctatgaacgacttgaagcatcaccgactgctcttcatcaaaaaccggtgcctcgcatgtcctgctttgcgccgctgcccgccacgtcgtcaaaaggtcttggttgaggccgaatctcggttcagaatctgcgcgcgtctgcattgcatccgattganctgctgtcggnacggtgctgccngntctggaatgacaattgcgactactgctgctaggtacctgnagcatcaaagctgtaagntcggccagctcccacaattggaaangtttcgagaaagnaggggcttgaaacgagngacngattttggccgnanaggggcantatcgtcangcngcccttngattgcattctccaaggcaaaactctnagtatntgacaaaaatacngangggccgncggnaaaaatggaccggcnccaattgctccttngnttgcaagnattntttcttgggggtctgagnattggncccgattggtggacngccgggtttcgnaacaactcnaaccnttttggcncgtacgnaaaaaggggnnattcggcccaacgnaaattgtccgaantcaaactttggaaaantcggtccggtcnaagnaaatgaaaccttgcngggagnatctnggcaccgtttaaatcgntgctaagggaccacccgttnttnggccgaacccgga

SEQ ID NO: 7774 - DNA, 776 bp, Tricoderma reesei
  misc_feature (1)...(776): n = A,T,C or G
cttcttcccttttctcttctcttgccaaatcattcaccatattcctacacctctacccatccatcattacatctttgaagcatcatgggctcttccaaggcgtccgatgctgcacctccccccaggccctctcgtggctgggatgccaccgcgcacgaagctctcctcttgtgcatcatcgatgaagtcaagggcggcaaggcgctgatgaccgaggtcaccaagaagatgcaagcccgaggctacacctacagctacgatgccatcaatcaacatgtccagaaattgcgcaagagccgtgatactgcaggcatcgtcgcagcctcctccgagcctggcgctgcactccgcgcaagagcgccactccgactcctcgcaagcgccgctccgccaagaaggagattgacgatatggacgacgccctgagcctcaagctggagcagcacgaagatgaggagatgggcagtccttgcgagcgcccgcgtaagcgcggcaagtctctcctctcggccaaatcaacgccttggataacgagaccaagcttgagaacgaggatggtactaagaagccacctggatggatgccacggttacgaagagttgactgaagaattgggaaccagttgacgccctttgaggtgtgggatatgggttgaatcaaagggctagctgggtcaagtggcatctgcattaaggcaaaaaagacattcncatattcgcanggcatataccgtctttttcaagacanggaatgattacatgcagaatttgaccttt

SEQ ID NO: 7775 - DNA, 118 bp, Tricoderma reesei
  misc_feature (1)...(118): n = A,T,C or G
ncctcaacaatattnccgatcgttgtgacncgngccttatctttantcgntctccncattgctaccataatgttcacatactnctatcgtcgactggtangctacntatatataagac

SEQ ID NO: 7776 - DNA, 469 bp, Tricoderma reesei
  misc_feature (1)...(469): n = A,T,C or G
nggaaccttttngaaccaaccccttttttaaantttcactngcccgccnattcgnactgattgctttngcgtcacanaaggccaccattaaaaacaantggcttgcattgtggaacttggcattnccgaccccnancaccgggccttttaaggggaagaattaaaaatgcttgatggtggtcncccaagtntcgaccaanaagactnggccgccaactgatcnatgactttgaaggaaaaattgcaaaaaagaaaaagaggacctttgttgcactattgacagacgtgggatcaacgggcggaaaatatgttattctccttaagatttctatcatgggnaccaattccaactttngcattttcgcacttaacggttccttgaaggacgggccgtttttttcaaacacctttgcgccacttaanttnaaccaggttttnggccatnttgttaagcttanaaccttaaaac

SEQ ID NO: 7777 - DNA, 760 bp, Tricoderma reesei
  misc_feature (1)...(760): n = A,T,C or G
nncaccacatcccggctgcagttcaggagcctttccagtgatcctctaacaagtcgcatcacgccccccgtcgcaacgccgctcagcgcaatccctccagctgcatctacacttgctaaagggactcctctactctcttccgaatagaaaaaagaacaacttcaatccctctcacatccgccatggcccaaaccctcgagcagcgccggcgcaacgccaagttcgccaaggaccaggaggccaagatgggcaagtcggaggaccagctcaagaagcgcacaaaggagacgcccaagtcgccatctccctgttctggctcgccgtcttgcgtttgtcgtctttggcgggctcgtctttgagctnctgtcgcgcttcttcggcgtctaaaattcgaatcgatatcaccacctactccatgtcgattttgaaaaccagacagaacgacagggatccaaccagaaaacacatttggcgacgggagaangaaacaaccgaggaaggaatatcgaacgcatacaaggagggccggacnggttttgacatggtcaangggcagaangcgaanatctggtgaaaagtgagataccgtcgacgagccgacactgggcgctttgttttgcgtgcctgcccgggtcatttccggngtgactttacagcagacgtatnatggggatttacggggcactggcattggacatttatnatttgggnttttacaanaaaccaaggggaaagcaagaaagaanaaacnttattnttt

SEQ ID NO: 7778 - DNA, 530 bp, Tricoderma reesei
  misc_feature (1)...(530): n = A,T,C or G
aagcccacgacgctctccaatctgctgccatccatgctgaggtccgtgtccttaagaagctccttctccatgaagggcgtcagcgggcctggccgtgtgatgccggcgtcggagagcaaatcagcccagggtccaagaatctcgtcgttgacgtcgtcgacaacgctgtcgaggttcatcttggcaaaagtgctgatcagctgcccttggaagcccgtctcgatcttgaagatttcgccgatgatgtcggccatggtgccctgtgtagtggcgcccttgtccaccacattgaagatgggcactttgcccatctcgctctcgttccagttgggcttgccggcgtcgtaccaggcggcaatgtnccaaagggctcgggatacggcagctcatcaaggacaactgggaccgcctggcgggcgagcatcacgcttcgagcaaggcaaagacgtttgcccgacgcaaaagggcgaacgtccttgcgcggcctgcaaggttgccgaaggccgccattggccgccgcccggagcttg

SEQ ID NO: 7779 - DNA, 518 bp, Tricoderma reesei
  misc_feature (1)...(518): n = A,T,C or G
cccctcacccgcagcaccagcaccagcaccagcaccagcaacagtggacacctcaggaacaacgacgaaaaccaacgcgggaagccgtgccaatctgacggtattacttatggatgatgccattttcccccctttgcggctgcggtcatcgcaatctcccggttgcgtcgttgctccaatcacggccatctnggcaggctgacgcgcagtgcttaagggacagtattagctacatatataccaagcacaagcacatcttcttttcncaactcgggaatcgatggttcgtgctttaattggtagaatgggttttggtgcatatactgtacctacagatgccccctattggatgccaaaanacatcggtcaangaagatgattgcgggtcttacgcccgatgaataagatcatgtatgtaaatgaggnataagatgcagaatattggaggaactggcgcttgcacccggccgcttngttntttaggcgatcgtcgtcacgccgnggggaaaaaaaaaaaa

SEQ ID NO: 7780 - DNA, 384 bp, Tricoderma reesei
  misc_feature (1)...(384): n = A,T,C or G
gtcttcttgccctactacctggccagtcggggcgtncagtttggcgtcacaagcgcctttgagacctggaggaactatgcgctggtacaggtctgcggcatattcggtcctgtgcttggcgctgtcatgtgtaactggaagcccctgggacgaaggtataccatggtcattggggccttgattaccatggcctcttctttgcgtactcgcaagtcaaagtctcaggtggaaaacattgnctacagctgngtcntcttctttacgctcgagatctactacgggngtgctcttacngatacactgnaagatcttntgntctttggccaatcgtgggcaccgggncaacnggaatccgccggtcccnttttggtcnacttngccgga

SEQ ID NO: 7781 - DNA, 565 bp, Tricoderma reesei
  misc_feature (1)...(565): n = A,T,C or G
cgaatacgatggaggatgatgaccgaagatgatggggacgaggganaaggcgagggcgaaccggaggaggaagagacaaagatgaaagaagaaccaccgaagcctgttgctgcaccagcaaagccagccagggccgcaagggcaccgaggtcagcgaagcccgctgcagagccggctacgaaagaggtcaagacggagacaccaagcgtgcccgtcaggagcggctgggcggntttcacctccagaccagcagcccctgacgtggaaatggccgagggcgacgaagaaaaattcgaggtggtgtaatgaagagaggtgttgttccatcttgtcctttagtgcgtttctgtggctttatgtgcccattcaatatgacctgcgcgttgaaaanggattcatgatggttaaaanggggtttcgtacaccgatcgcagcatatctntaccaaanttgtngatgcaaaatggganaatgagggcctgtatgtatgganagagangggtttcaaagctctgttggcagcanccgaccagcgaacatcaaaatgngattatcgattgtctct

SEQ ID NO: 7782 - DNA, 471 bp, Tricoderma reesei
  misc_feature (1)...(471): n = A,T,C or G
agagagctctaaagggaaaaaagtaaaaccacaagaagtcacaccataggtcttcctttggagcaagtgactacctcctaggaagcatgggccgacgactatcacgcttcttcccagcccttctcgccttggccgtggtgggatctgctgccggggatcatgtaaaggcagcagcggcatactactcccatgagggtcgatgcgcggcaacgganccgagcaagaagcccgttttcgtcagancacaaacctgctgctgctacaaaaggagaatccccttgaccggcggagtttggggatttttgtgagggagcagctagacaaatggaaggntnctggtattgcggtggcggttgttgantggggatgaagncgtatgcccagggctatggatatccgacgctgccagatgtccanctacccccgagacgcttntggtccggtgccgttaaacgacaaaagcttacgtcg

SEQ ID NO: 7783 - DNA, 798 bp, Tricoderma reesei
  misc_feature (1)...(798): n = A,T,C or G
gacaaacagcgttagaagcctcaggctgccttcaagatgatttaaacaaacctctttagagcgtttcttccccctccgtcaaaattcagtcccaggacattaacaacattctccccactcaatcttctcgttcagctcaccattcggtcgacctgaacttcagccctgctttgaatagcatcaagcacgagttctctcctcaacgccaacatttcctctcaaagactttcaagtcttcaccacggattccaagtcaacatggcttcccaactcaacttccgccctgccggcaccatccgagcatctgtcctgaaccccgtcgagaatcccaagcaggactttggtctgttcgacaacccgccgcctcgtcaacatcataatagtcgcattggcaagtacctagccaacggtcggnactcttggcacttcccggtcgcgagaagcacgctttaacccgcaagtccaagaaccaacgaggtgggccaaaattcttcaaggctatcggggcacccaagaattggcttctgcatacggcaaatcgttaatcgaatcagttctacgcatccttgggttcaccccttaactggtctccttggaatcggncttttcgcaatgcaccgggcaccaagtacccttggtttcantccgacactgggtaaccctggncacaaagccgccaaaatgatgaacgctggagatgtcgatttggaccnattcaccgtcttggaaaggaggngccttcacggggctttttttttccggttgcgctttcagnttcgaanttancaagcggngcct

SEQ ID NO: 7784 - DNA, 390 bp, Tricoderma reesei
  misc_feature (1)...(390): n = A,T,C or G
naacgcaagaggacaaggtngatgctgncgctgacaagaagcccgccgatgccgagcctgaaccgatacccttccacaagctgcccgatctcacccagggcattccctcgacactcgaggccgagctcgagcagaagagcggcaagtcgccgtcngtacctggaagtcagcgagggggagccgtcatctggaggaggaggccgcggccgaggtggcagggaagaatatgtntcgaccagcgagcgcaaccgnaagtggtggacttcgcttcatgctgaccgtggccggctcgggatccgcttggtgggcattgcgtacatgggtccgcaactgggaggacgaaatcgaggcaagagcgccccccgacatccncaacgggatggagcccca

SEQ ID NO: 7785 - DNA, 371 bp, Tricoderma reesei
  misc_feature (1)...(371): n = A,T,C or G
tcaacccggaaggggggggcccgggggccaaaaaaaaagggnaaaaaccaaaaacccatttnttccttttttcaaaggnaaccncaatttctttaaccgnccccaaacccccggnaaaaaaagggncttgggcccgggtncgggcctccaaaagnccaaaaaaagggnaaggaatttccccgttnccgncaaagncgggggaatggaaagccggaacccttttcaaaggcccggcaattacgaatcctggaaacgggcngcttcccccctttgggttacccggttggtccaaccgggnttgaaagcaagttcgcctttttgaacgtgggcttttatgggcggaagaatnaaggcgcgggttttccttccaa

SEQ ID NO: 7786 - DNA, 440 bp, Tricoderma reesei
  misc_feature (1)...(440): n = A,T,C or G
ntcggcaccgaggctctcggaacagcccccgacagcccccgaccccggcgtctagtctgtgatacaaacattcgaaccctcggctgtactctgcactccggcataacagctcgcacgagtncataaaacatcaacgcctgctctcgaggcctacctagtagaactggccttccaccgactacctaccacgacaaaccacagcccagcttcacaatggctatccgagagcgattccgncgtgccctgcgcagatccgacgactcagacaccatcatttctcagacagactcaaataccacgacatgcatcggtcgtcggncccgacaagagcttcagctccgaaactcgctccccagctatcgttgaataagaccagnttcaacatttatcaaggacacntcgcctcattcagcctccgcagncangggaaaaagggacat

SEQ ID NO: 7787 - DNA, 184 bp, Tricoderma reesei
  misc_feature (1)...(184): n = A,T,C or G
ncactttattntttcncgggaaaggccccccggncgntaacctnttggcttgcaatgntctacagtcanaggaccacaaccncccggantggntgatgacctaccatagttacnttngaattgggatccangatgggtatcgcgncccccggtaaccccggagcgtcctggaaanctcnacgac

SEQ ID NO: 7788 - DNA, 507 bp, Tricoderma reesei
  misc_feature (1)...(507): n = A,T,C or G
ncccatcagataccctttggccgatccttgcaactgtcggcggcctttctcttctattcagctctttttcccctcgcttcggacccgaaagactaccgacgacaagcgaccaaaggcctgncccataaacgccgtgtgcnaccagttctgntggcgacaagggtctggccttagtccctggcgcctcgaagcaagggaaggaaaaaaaacaanancattcccaaaagaaaagaggagaangaccanggggttcntacggggggtctgtngggtctagcccaacaacgccttggctttgccttggnatgcatcggctgctggctntttttttntggttgggcccttttcttgctttntttccgnacagcactgacgngttatactttttggtgcaccttggantcaattacacncattntttttgnatggggctgngcgttaaaaatggccttttttttttaatttggcctttttttttnttggcttcatatgggacnangggataaa

SEQ ID NO: 7789 - DNA, 259 bp, Tricoderma reesei
  misc_feature (1)...(259): n = A,T,C or G
ngcacgagggtgagcccgcagtagccagatggcatcgcgagactacgctccccagatcaagctcgagcagtcgcccgccagcctgcagagctcggtgcccaacgtgntccagccgggtggcntgtcacgcccgcccttgtcgtccaactcgtcgatgcatcccggtgctgcctntggtgcctccnactccgncgcctctgcctctgcctctggcgctgnctctgnctctggcccggnccaagcatcagcctntggctca

SEQ ID NO: 7790 - DNA, 504 bp, Tricoderma reesei
  misc_feature (1)...(504): n = A,T,C or G
cttgttttgggtttggccagcaaacccccaccaccacgggtgtcctctgtttaacactacgaggctcttacatgatgtgtcttgtcacactttctcattcaacgggccctgaaacatattggggttcgctttgcagccgtcgattctcctttgttgctcgcagcaacaggcaagagcgggaagttgtattagtccatgttgtctttccttcgtccttcatgtctggtgcttttctggttcttgtcagtattatctcttggagtttggccacacacgacggggtttgtctttgtttcgcttggcgctcacaagggcatatgggaaagtttggtcttttgcctttctatgttggtttcctgttttggttgnctctggttcctttatactgcgcgctggattcggttcatgacaggtctcgccgatggaagtcactctaccactacggntcatctcctgnggtacatctctcacgggggttccttcttgncacgctcttctatacgt

SEQ ID NO: 7791 - DNA, 369 bp, Tricoderma reesei
  misc_feature (1)...(369): n = A,T,C or G
ngttcaggtgcngcagcgatacccgtttattccttacccgccnaccagccaaggcgcatncgcctngcaagntagagcccggcagactccaactcanccggatctgcctcttanaacaccnctgctcccnagagccgncggctggcgccaangnggacggaagcacatacacatgcacatatacggntgcactctacggtttgagacgccccaggctgttgcagaaacacaagcgcgagggccaccggcagncgcacnggcttgnaagtgcccgcncgcacnacgaccacatgggcattgacctcgagccttctttaacaagccaggtcngaccccaacggttgagatcgnattaaacnccgaggcaac

SEQ ID NO: 7792 - DNA, 633 bp, Tricoderma reesei
  misc_feature (1)...(633): n = A,T,C or G
nccaantcatactcttctcgctctgcctcagggaggtcatcttatacactcccaaggaccagccgacntatngggagctcnactcgcacgtcangtggaactactcggacgatatcctccaagccctcgcagcgccatccgacaggcccgatgctcccatcaagcggacaggcccgacaatgctcaggagctgggagtggagcgggaggcttctgggcggtcctgtgtccacctttagcgacattgtccgagttcaccaaatgcctgcattcaatcatctcaaacggctgagcttcacaaacttccaggcgccctcgctgctcnagggtgatgatgaggatgacgagggccacaacttggggatgtcactcaggaactacgcttgcaccactgctgtcgcanacgcatcgcccagctnaagtctcttgaacacctcgtctttcantcctctacnatcatgacgaaacaagctgctttccttcttccaaagacttgagcacctggaactcatcaatttgctgggaanattgaagtcttgaagaatctngccccagttttctgcttcactcatggnncaatgcccttccncgcccttgacccttgatggcattaattaagtcgcttcaaaccttc

SEQ ID NO: 7793 - DNA, 356 bp, Tricoderma reesei
gttgcacgcttatcaaacggatacatctgtcgctgggtgggctgagaacaagaagcgcaatatcgattcatcggaagtcgcggcttatcagactgacacgtctgttgctggatgggctgagaacaagaggcgcaatattgattccactgaggtagcagcctatggcggcgctaatgttgcgggttgggttgaggacaagaagcgtagtatcgattcttccgaggtggccgctatcaaacagacgcctccgttgcaggatgggctgagaactgatcgcgtcgtcagaacaaggagctgtctaacctgtctaacccttccatagcccgagagcataattgacacgtcttgctggcggg

SEQ ID NO: 7794 - DNA, 383 bp, Tricoderma reesei
  misc_feature (1)...(383): n = A,T,C or G
gagctgaacgtgctgctctcggcgagggaccgttctatgagaaagagaccaacacgctgcgtntggtcgacatcaanaagaagcagatcctcaccgtgtctctggatgacagcggagacggctcctccttaaagacgatacagctggacgtctgcccaaccgtcacggcacgacatcgagggagtggaccnccaggagcgcatnctgatcggtgtcaanacatggtcnttgcggtattggatcgtcagaagggaacatatgagctgctggccccattcaacacgccggancacaatgagcgtatncganccaaccgacggggcngnaagattccnaactggcnagttttcggcttggggactatnacggatttttgggcaggg

SEQ ID NO: 7795 - DNA, 283 bp, Tricoderma reesei
  misc_feature (1)...(283): n = A,T,C or G
natgctgcggaaagaagccaccgntttgacggacatgttcatggacctntatcgcgggaanttcgtccgaaaagttcnatttccgatccccaccttcgtccttttggaagncttgtnggcctttgaaaangtcnacccattntcttgaacacgaccggttgnnaaaccttaanaaaggacttggccgaatttttcaacanggatcctttcaccattaccgaggacnatgcgtttcgcgncttcaanaattgtccgntggctcttccccgtgggggacaaaaaa

SEQ ID NO: 7796 - DNA, 907 bp, Tricoderma reesei
  misc_feature (1)...(907): n = A,T,C or G
nttanggcantcgcacgagcgcttgacgctgtgttctgggacgtcccccttgctgtgcaacctctttcagtcgtttcgagctggtctctctcacacacacacatacaccacacacaaaccaccatcgcgtcgaatcggccaattctcttcggcgacccttcggggcaggcggccttttcaattaaacattttcctttggtcttcttaagtctccttctnggtctcgcaccagcaatctgcgcgccaaggcatcggccaatcaccgcccgccacggttggcccgcacagaaaaccacaggacgaacccatccgccattcgcaattgnattggccagnaagatacacacaccgcaacccccccttccagacgggggtactccccgcacttccaacttcttttttggactnnaccccggaataagtaattcgctnacaaattttggcngcgaccattggtatttcaccaggcacccccgggcccattttgcggccctagaagccttttagctctgaggattacgcgatggaaacgggtggcagtgataacgcaaacgactatgccttgctcttcaccatcaagattcccgtcaccagctcgaatgtaggatttacaaggacgtacttacgagtagcttactaccttacctaccatcacgtccaacgtaggtcaatgctgcagttgagtcagagtntcgacacacatgcctcttagttcatagatgggcaagtggctatatatagagctctctatgcagttttatttctgcattaacgccgcttcaattcggactgtaattaacangtcggggngnacctgatcnganccaacggaacgcggtgctacaaatatntgcccagtgagatgagggcnggtcctttgggaataaaaattttccgggttngacnt

SEQ ID NO: 7797 - DNA, 123 bp, Tricoderma reesei
  misc_feature (1)...(123): n = A,T,C or G
nggcaantaangcccccctccncccctnttgntcccttctaaaagngggctaaanaaaantactctatatcncccaaagagnggcggngtnttttctcccnaatatntttttgcaaaatntct

SEQ ID NO: 7798 - DNA, 656 bp, Tricoderma reesei
  misc_feature (1)...(656): n = A,T,C or G
cgatccgnaatacggngacaagcctctggtgctaaagaaacgcgtcgcatgtcccattccggatgacgttgaagctctttcggacggcaccgttcagagcaagagcgagagcaagaattcaaagcccgtcaaggacgangagacatatgaaaagaccaaagtcaagggtgttgcanctggtggatatctgatcggcncgtcaccccgagtgtgatgtggtcgtcagcgaaggagtcgtgtccaaccgacactgccttatattcncagaaaaacgtttggcacngataccgtggcccgttgtccgaggatgtctccagcaacggaacntacgtcaatgaggcccttngtcgggcgcaaccagcgttgcgagctgnaggaccaggacgagatcggntgttacnggcaaagcgagattcgtcttcagatacccccagagccggcaaacgagcgccttctcacaacatacacgctcttggacaaagctcggcaagggccactttgnagaggtctatctgtgcgtataaaagtntaccgggcaaagcgatacgccgtcnaaaatcttcacacagcatcccgggaaggacaanaggttccaagacggaaggcctggaccaaggaaattggcgttcttatggggtgtcagncattcccaatgt

SEQ ID NO: 7799 - DNA, 844 bp, Tricoderma reesei
  misc_feature (1)...(844): n = A,T,C or G
agaggtatccaatccctctctcttttctctctctcttcgacttttgtttcaggaacaaaagcttgaggatccttcttgtcttcctttcgtgatcttacggaaggttgtatgagaagattctctcgcgccagcgcaagccgtcaacctggactttgaagcccgagttcccgtgccctttagtatcttcccgtccacttacaaggacaacgaagcagcacgccctcagacccaaatcaagcgttcacgaggaggttcaactcaccctccctcaacacaagccagccggacgggagggtcaacactcttctttcccgcaacacgccgactcagctcctnctcgcggcgaacaccgctttgaagaagaggtccgtatcacgcgtgaggaagaacgtnaccngccgtccnggttcccgncagtcttgaacgcttcgtgaaggaagagttcaaattcattccaccttncttctngcgactacactgagactcaagtncaagtcngacacttnttcgccgnttcaccaaccccattgacgcttgctgagcgtgagtattcgggaacggtatncgtcctcaccacccagagagcttcnccngggcctnggaacttagtttgttccgcccgtncttcgtnaacttccgaacaaaggttttaactaaacaactaaccanctacaagntcctttcgaacttttaaccggtngggccgaacgaagccacacttttttgggtgggccccggtccccaaanggtttcccggggggggggnggaattcaaggaatcnccccgggngggaaaaatnccgggggaggttnttnttttccgngaaaggttcccccggaaacc

SEQ ID NO: 7800 - DNA, 548 bp, Tricoderma reesei
  misc_feature (1)...(548): n = A,T,C or G
aggcagtgtctcttcccatgaggtaattgggagccaggatgcctttgaggaaagcctcaagaaaatccgacactcaatctccgaattcagggacaaggcagtcaagctggatgagcgcgcggcctgggcgaagaagaaacttgaagaaggccttccatggtggaacatcatcggcaaggccagactcgggctcacgatcatcagggtgaaccaccaatacaagtatatcgagcgacaagttngtgtttgaggggtgggcttggacaaccgcaacttggttcaagcacgttgtcttttgttcttgcttggggaccggctatgcttggtgctgctatcccgactcgtcnaangcatcgatgcaaagaatnncagcaatggtcttgaangggcttggattatcaanccccctntcgacaagnctccaaagagcatcaagtaccaaattgcttacctgtgaaggtgaccgggaacttttattgtttgnatgaataccatgtgcttacccatcttccatattctggtattttactgcnttatngtaaaaaaat

SEQ ID NO: 7801 - DNA, 1069 bp, Tricoderma reesei
  misc_feature (1)...(1069): n = A,T,C or G
nnttatcctgnaacatttcttnggtatacggtttactgcgtcagtgccgtacatgcctagctgtacagccgttcctctatcccctcgttacatnacaccataacatatcgaacctttgttgaagcttcgacatcctctcacttatacaatccttaactactattttgactactttgtcacgtccatagctgcatttatatgtccgtataggtctacagtnacgctccacacgtgacccgcgaagaatggtcaaagagggatacgaacactcatcactgccaacgccggcttataagttgcaattcgagttgcatcacaatcacgcgtcgaacaagacaaatccacaataacatctcgctatctttgacgtggcaagtcaacctcgccgtatgctttgccatctcagcctctttctagtcaccagatttgcataacgcgatgtccgctaccctccaagtcttccgcgtggcttcggccgcgggatgcttcccttggcttcctgatatatatcaccatcgccaccttgtgcttgttcatcggcacatcttccgcccgcagcagcgagcgatcgaactggcaactggacctccctgacctgttcagatcccggccgtgcaggatgctctctatatgggctgcgcccagcgcttggtccgagttggacgcccgacgacgctttggaanggacgtcattccgagtatggactcagcacgacgaggggcaaaaaccacgttcaagcgtgtccgtcatgaacacngctccatgccccttaacgaaacggactggggggttaatcgcttcccgaaggcaactgngatcagaccaaacttgggggtattttntaagcagtaaccggacccggggttacngggcccggnggctnatttgatttatgaatcccttgggggcattaacgagaatgtctacaaccttttacaatgncaatttaaggatgcccgancaaganatcgntctttttttgnattttcccatgggacaagcanttgnaccgggccttccnaaaccgccngccgngggggtaccaattttgccnanatggtgggattt

SEQ ID NO: 7802 - DNA, 349 bp, Tricoderma reesei
  misc_feature (1)...(349): n = A,T,C or G
gagtacaaatagcttggaaggtgctgctggttaaaggaatttccttcgagtatacttctttgactggcagacctgctacgaacatcattgtactgaacgacgatatcttgactccttcatcaatctcgccaacctctccatcgcatcgcatcacatcaaacagcatccatcacaatgtctcttcaatacttccccgcggttaagccctcggcatcgtcctcggcaccttcttcaaccacngcgtcgacctcgtcgtcctcgcccccgtcttcggccagacgtaccaccgcgcaaaggnntccaacacccaaggaggaagttcatccgctnccggcgaggccagcgggcg

SEQ ID NO: 7803 - DNA, 733 bp, Tricoderma reesei
  misc_feature (1)...(733): n = A,T,C or G
tgtcctggctttccactttctctgccgcgtgcttggagtcagcacacggctgggaggaagttgcagtaacgaggaaaggcatctacggaaaaaatgcaaacattttgaggcggccctttttttgtagttttctcggtctcatatcccatgctccgacggaggggaaatattaagttgtcaacaaagagctggcaggtctgtaccgactttggatatcagaggttcaagcaatatctgcgtgtagctctcttccaacctcaaagaagatatataggccagtcccggcgtcataattgaagtcgtccaaatcgtgtgccatatcataaagagtactcatcaagcgtagagggcaatgtcgagcttgtgaaaaaaaaaaaagttgccgcgactgaacttaagcagtagcagcaggagcctcggcagcaggctcctcggcggtgccgttggcgggaggcgcgtttggcctcctcatcggtcttgtcggggctatcgatggcgaccttgacggcgatctcacgtccttcaatcttcctttccgttcatctcaacgaccggccttttgctggancttcttggaagccagggtgacnaaaccnaaaccacgttccttgngtgccttttccgcggtgcctggagcttnttgatcattaaaccggggatggggccgganggcancttggcttgacaaaggtctaatctttgaanaacttaaaancntttttcttggtcaggt

SEQ ID NO: 7804 - DNA, 104 bp, Tricoderma reesei
  misc_feature (1)...(104): n = A,T,C or G
gctacccgcccatctcntgncggagaanggnacactcttcntgggctggtanctgtcttgagccgtcncctagtncganctggagctgattctnantggccggg

SEQ ID NO: 7805 - DNA, 199 bp, Tricoderma reesei
  misc_feature (1)...(199): n = A,T,C or G
nngaccgtcgcacgagaccaatcttgttantctccaccaggctngtcatcacacgatcgagcgcattatctcgantcgactgcttctcggaaaccacctttatctacctgctctccaaggtaatagccacagaaatcgaggctcntgctngttttcagcngntcaacatcttttccgtccatnccagatacgttcacat

SEQ ID NO: 7806 - DNA, 458 bp, Tricoderma reesei
  misc_feature (1)...(458): n = A,T,C or G
ccaatcctcatcacacgcttgcggcttgcatccccaaagccgtcaattccatctgaatcacctcttttgtctcttctccctcttcacacatccccccgcatttcgcgatggctgagagtaagacttcggccatctctgatgagcccatcaacgtcctcattgccctgcaccccaagttcgacattcttgacttttccggtccattggctgtcttttagcgcagcgcaccacgactttctccgatgaactggatgtatttcgaactcgtgnaagaagggccgcgggtgggtggtcccccttttatgctggggttccaaatgctaaccagttggttccccggnacntgaatancttccaaggattttgaagtgaccctggccgngctngagccgaangttcttttcttccaagggcgcccntcgtgcangtccanaatacgtcaaaagaagnctaacgag

SEQ ID NO: 7807 - DNA, 284 bp, Tricoderma reesei
  misc_feature (1)...(284): n = A,T,C or G
ntcaatntgngcctactatacccggatgcccanaacatcacgacatcatcaccggnatcgntggcaaacttgcaannagggagcnatgtgctattatgcctgccttccggctacanaagacncagtggcccaagntcaaggtgcgactttggaggcattggcgncntgtactgcacgaggacggnttcttgaacttgnctcntcccgacacccaaactttcccaagcttgngctgccgtgtnacattaaanacnaccttaattgattcggttgctgtgccgacc

SEQ ID NO: 7808 - DNA, 165 bp, Tricoderma reesei
  misc_feature (1)...(165): n = A,T,C or G
ncncttattgggcggtccaaaatnnaaaaattttgttactggganaaatggggttgncantatggtttcaanttggacctacttaggattttcccccaacangccctttggtctaacttnaaccctttnttntggccaacngcctttatctaaanggtcttaacc

SEQ ID NO: 7809 - DNA, 201 bp, Tricoderma reesei
  misc_feature (1)...(201): n = A,T,C or G
ncacacggngccttgggctcaagcctatgactgcctcgagatgaacaactacnacntggatacaaccagggcggctactatcaggngcatgggcgactacttcaacgatacggatacancnagcccccgctntatggtcnagccgtgcggggctaacanacgantggcacgagttttnaccgccatganggatatttcacc

SEQ ID NO: 7810 - DNA, 152 bp, Tricoderma reesei
  misc_feature (1)...(152): n = A,T,C or G
nntcgtatggtggggcgagcannttcctaccaaaccgttnctcncaagtncggnatggggtacttgagacangcgaggctgacncctactctgacnttcttnagtggcactccactntccngggatggaagcctcatccaacaacgcgacca

SEQ ID NO: 7811 - DNA, 853 bp, Tricoderma reesei
  misc_feature (1)...(853): n = A,T,C or G
agactctccctgcgctggttctgtctgagcgtcacctgtgcgacctggagctgattctcaatggcggtttctcgcctctggagggcttcatgactgagaatgactacaaccgtgtggtcaaggagaaccggctcgagagcggcctgctcttcagcatgcccatcaccctcgacgtggaccaggcgcagattgacgagctgtccatcaagcccggcgcaagactcacgctgcgcgaactttcgaagaacgaccggaatctcgccattcttgacnggtcganggatgtgtacagggccagacaaggtccagaaagccaagctggtctttngcagcgacaatgacaccaccccggcgtcaacaccttctgagcgtgggccaaggacttttacgttggcggaaagctcganggcatcaacccgtctggagcactacgacttcttcgacctgcgtttccttccgcggagctgcgatccactttaacaagctcggttggcaaaaaggtcgtggcctttcagacgcgaaacccgatgcaccgggctcaaccgcgagctgacggtccgcgccgttcnttccaacangcaaacgttcttattcaccccgtcgttggnctgaccaacccggcgacatcgaccactttacccaatccgcgtttaccgngccctgntgcttgntaccgaacggattgggcgncctngcctggtaccctgggcatgccatgggcggccccganagggctntggacnccgngatcccaagaacacgggcccnccntttttgtcggcgggacacccggaccgnaaaaaangacggaaggacatncggccgtcaagccaaatcttttcaaaacacaaga

SEQ ID NO: 7812 - DNA, 131 bp, Tricoderma reesei
  misc_feature (1)...(131): n = A,T,C or G
ntgaaccctttgagggaggccctgtccntgtcaangatcgggtgcaagactnngttatttttacaattgggatctcgtcccaaacgggagcattnnactttttnattccccaagacaacnggacccccttt

SEQ ID NO: 7813 - DNA, 190 bp, Tricoderma reesei
  misc_feature (1)...(190): n = A,T,C or G
ntttnctggaatattaaaaatccattggaaganctagcatcaccatggnttcttanaaccccccaagcccaanactttgntcaaattccaagcgccgangtaaaaattnaagtcgngggcctttttcccaggccacccncgttaagngtccttcccgtcccttttngttttganaaatggacnccgagtt

SEQ ID NO: 7814 - DNA, 560 bp, Tricoderma reesei
  misc_feature (1)...(560): n = A,T,C or G
acnaacacacaccaatgggagacatggcatnttatacgctcatgaaaggactggccattaatcnncattattctgcagtatacaaagcaactcaactcgganaatcaacatatccccgaatccgtcancccgcaactcatcaagcagatgaacagcagatacctctgctgcgctggttcggattaaatgcatcctggcttctcctaccccgatcatggatattctgcccgccgatacccagtcaatgggggtcatcttatgggcggncgaccccggccgctacgggcttcgacaagtccgcccaaactccgcgactggggctccggggccaagtccgagcatcacggcggcatcctttggcttgaccgtcatnctctgaaccatacattgtacatctctttctgagaaacttcngctcttgtgcttttnanttcagcttcccngngatactgccatcgccggtatcnggtaanggagttatgnttcaacttaagcagtcccttgagagancgaagcccccacacttccgcgggcggacaacgtttgtttntnttgccgcc

SEQ ID NO: 7815 - DNA, 201 bp, Tricoderma reesei
cttctcccttctctccttctcaaccgctggcactgccctgttggcatcacttctctcccccaccgtcaggttttctttcttcctgagaaaacacccgctagtataccctttttctttcttcttcttcctctttgcatcttactgctgcaaaacgttgaactttgcgacgcttcttctttcgccatgaagttcaacaccgtc

SEQ ID NO: 7816 - DNA, 837 bp, Tricoderma reesei
  misc_feature (1)...(837): n = A,T,C or G
ctgcttcttcattccttttcctgcctctgtcttgttacgctcttttcacgagaaaaccattgtcatcttcggtttttggtctttttcagcgcatttggatttggcattttctgagcttctgctctgtactgatctcgatttctctctttttttctttttggtccagccgaacagaactgcatcatcgactccagctcgcccgacgttttttccccggagctggcgcctcagtcttggcactggtgatcttgaccggaatcgcgacaccccggtagctctgcacaacagaagcagcagcagaaggcgacgaacaagcaccaatcgataccaatcgcagctattttggcctctggtcattcggcataccaactggagaagcggacaaatatccctgctgcttttttcgcatctcgatttgcagtaagacggcggttgaccacttcttgcgccgtgcgaccctagcggcggcagggtccggaagctgcgcagcgctgtcaagtcgagttcgagaagaagggccaacagacaaagacatcgtatatctggtctcatcccttccggttttcttctggcggaaccaggcaacaagcgcgttttaaacggtcgccttttcaaaagccgcaaaagcttnacagttggcaacggnaagccggncatgaaccgttcnaatggnaatcgcngnttactggccatgatggangccggggccttcattaaaggtccagtacccgtttgggcgtatattgnnaaatggatgtntttttcnatgnaaccattatntttnacaagngggttttaaaacctgntggaattaaanaccccattnttcttacatgn

SEQ ID NO: 7817 - DNA, 166 bp, Tricoderma reesei
  misc_feature (1)...(166): n = A,T,C or G
ntgatantctgcaattngtgttccaacnacgngaaccactcangtgtaagatctagattactaccataccgtgtgttgaacnggggctcggttcgcganattcgtgggtccngcantcggnccaattcatccaagngtgaaaagaggggggcgacttacgcntgga

SEQ ID NO: 7818 - DNA, 125 bp, Tricoderma reesei
  misc_feature (1)...(125): n = A,T,C or G
nacanggagcangacggtnctcgnaaantcaaccctcantgtcctcngtcagactcaggtcgaaccgcggtagtgacttctgnctcaagacngactttntatcggcgaggatgcncacctaacac

SEQ ID NO: 7819 - DNA, 288 bp, Tricoderma reesei
  misc_feature (1)...(288): n = A,T,C or G
ntaatnttgccgnccantcggcacgnggatacgctcaacaacacgcagaagcggctgtacggcatcgccaacacgctgggcgtgagcggtgacacgatccgnatggtggtagctgccgtgcncgtgaggacanagtnggattctttgnctgcgggctgtcatgggactntntttcttggtttcgntgncttccgcggattncacttttcctaccaatgnaattgccaattntntgggtaagcnctgccnggagccggnnccctttgggcggttttttnanggctatgg

SEQ ID NO: 7820 - DNA, 154 bp, Tricoderma reesei
  misc_feature (1)...(154): n = A,T,C or G
natctttcttctggncatcttggttttttttggncntgggtttttcanttncttggttgntccgntaaaaggggnaaaaaacttggaattggccaancaaccgttaccccgaattgaattccaagtttaccggggcccggttcntttccnggtc

SEQ ID NO: 7821 - DNA, 119 bp, Tricoderma reesei
  misc_feature (1)...(119): n = A,T,C or G
ntgaagcaaaggggtcnctcttttattgtggcttnnatactcttcgacaaagatccctcttattggagcaaaatnntggacggacatgcgcaccggcancgangaatgggggtaacttt

SEQ ID NO: 7822 - DNA, 322 bp, Tricoderma reesei
  misc_feature (1)...(322): n = A,T,C or G
ngaccaacttggttccatggaatctgntggtggacttanctgcaaaataatcttacatatacccggcccgggttaatggtggncgggtacatgcttccgaatttatatacatcttatcgggtttgcgcttaaactaccaacctgggtatattaaaacatgggcttattcctgaactatccgtggcgctcnttgatcctntacttcggcaangtattcaccctattttcactctgccgatatgacttgtgtatgcatgcctggaacactgnacagacagcacgcctggtgatcaacnnaacaacctgnattcacctctatgcg

SEQ ID NO: 7823 - DNA, 121 bp, Tricoderma reesei
  misc_feature (1)...(121): n = A,T,C or G
naccccacaccttngcncaactgaccgccntgaaaattttcaaagggtgacccgtgatggcttaactgactntcnctaacgggatatgagcctgcttcgcnatcccgacggctgcactgga

SEQ ID NO: 7824 - DNA, 437 bp, Tricoderma reesei
  misc_feature (1)...(437): n = A,T,C or G
taggtgatagcgtcaaaacaaacataaacaggggaacgaataccgggcacgttgggtagaggggcggtggaggcgaaagagggcaacagaagcgtccatcattcagcagcgaacacaccagacgggttccgtcaccggatcaacaggcagtaataacggacaatcaccctgcgccaaccgtctctcctaatttccctaaccgaaaacaaatccgaagttccatgaccactctcccctcaaaccagagaagcaacgcgcatgcgtaccggtgctgcgtntgctaggccagccctccaacatgattccatctatcgccatgttgaaagggcggggcgagagcattcagatataaaacaaaacgaagtttaaaaacgaccctcngtcttgtgccgagttttgagccgcgacanangtaagaangatttangaaagtacct

SEQ ID NO: 7825 - DNA, 326 bp, Tricoderma reesei
  misc_feature (1)...(326): n = A,T,C or G
ncactggnatcnaaaaggggccgnttcagaatgaanctccaacntgcccagcntggggttnaggaggagttcanccggttggnccgtggggatctttttgggnantgaccccttcgtnggaantgcccggcnaaccaangaatggtttaanaaaaggaaaatgggntgggtgnaagcanggccaanggattcttgttggganaaccattgaagtttnatttggaactttggccgggccccttgaaaaaaaaaanggggaattttggcnccttgnattccggggtggaaggcttttttttngggaanaaaaaantggcttngcttgc

SEQ ID NO: 7826 - DNA, 108 bp, Tricoderma reesei
  misc_feature (1)...(108): n = A,T,C or G
nggcctaacgactggatatacnaatcngcccaggaaganaacgcntctgagganatcatnactctnaatgaatccncgaactntatctactgttnnacatcgcggatt

SEQ ID NO: 7827 - DNA, 430 bp, Tricoderma reesei
  misc_feature (1)...(430): n = A,T,C or G
nacgggccggccacgangccgnattantgaaaggaacgtaaatagagcagagaagctgcagtctctcttggagacgttgacactccaggttttcttactgcccacaaccactgcacaatcacctctttccttacgcgagattgggcacaagaagcagacgagcggtactacgcaatcactgtcgcttctagactttcaattgcttcttccctctaatctacctcacaaacacaaaaattgtctgccatgaaggtcatcctcgccatcaacgccggctccagctccgtcaagatatccgtctatctggcgacaagaggacggngccgcgccagattgccgagtctcaagtgagcggactcacagctccgcagctaagctgaaatactcgcggngtggtgagaccgttattaaanacaaaatgtggacaatg

SEQ ID NO: 7828 - DNA, 358 bp, Tricoderma reesei
  misc_feature (1)...(358): n = A,T,C or G
nggaaaacaacctacccggacagcaacaatggggaagantggtgcaatggngatccgnacccggatttggtnttgccccattccggaaacacttggggancttggttggttggaattctttggtctngggtcaaacccaagccggncaagtggtgaacgggaccaancganaaggagtggggcttccaanttggacttccactggggcgcttcccaanatgcccttgngaaaccggngcctttaaagcttggnggcttngggttncaaacctacttttgggcnggtttttannaaaacccaaacccaatnggttcctgntaangggttttgnggacccgggctttnaaaacaatggat

SEQ ID NO: 7829 - DNA, 384 bp, Tricoderma reesei
  misc_feature (1)...(384): n = A,T,C or G
ntttaagctggncgacnactacttcgaaantnaaggtgaacaccntgaacccgnaagggantgggaaaactttccnganaaacttcttaacngcaccttccaaaacaaagaatggngctggtggnnaggggtcccggtnncccggctaacgantttcgnttnaagtttgacggnccagaaattnacaagaatatcttattggctggcttccgatgatgccgggtcacccaagangattacgccgctcaanganggttttaagcgatcctggaaggatcgctacaganccaggcaacgntttgacactcgacacttttcatcttaagcgccgtcttgccaaatgaacgcataacgaaacctgnacttnacgacnatntgatgcaa

SEQ ID NO: 7830 - DNA, 207 bp, Tricoderma reesei
  misc_feature (1)...(207): n = A,T,C or G
nccgatctcgcctgtaaacaancctctcganngacatctttcntgtttaagggggangggtttatngcccatcctcctatggatattcaaggctccggatcaaagcctngataatggtgaaaaataccccatnggcttcggantgatacgcgcaaccgtttgtctttttttnggatccggcttgggntgtatttttngttatnacgg

SEQ ID NO: 7831 - DNA, 265 bp, Tricoderma reesei
  misc_feature (1)...(265): n = A,T,C or G
ngggnttttntccnattcgcatcgncgagggcccatttgncctgcaaaccaccgaccanccttcggccatnctgganatgcccncgccagggntcttattgggcccgngtgacattcttgacaccctgctcaagcgctngggaaancaaggacaacatcgatccccggnaagtaccgntttcngacctttgccacggtcaanactggggacaaagccctatgccgagttnntcaactgngggctntgggtccccnagtggtgtgt

SEQ ID NO: 7832 - DNA, 223 bp, Tricoderma reesei
  misc_feature (1)...(223): n = A,T,C or G
ncccataaaagaaggaatgcgaacaggggaagaagtaatagnttttaattgggccnttggtttggngcccnaacttactttnttgcccccgcntggcnggtgncaaacaanttttgnaantacacaaaccgcntttctttttggttcntttggaantttgggncnaaccgcaaattcngtnttggggctttttnggggtttcnaaccttgtcnaantcccaat

SEQ ID NO: 7833 - DNA, 524 bp, Tricoderma reesei
  misc_feature (1)...(524): n = A,T,C or G
cacaaggtangccgcgaaaatcgagcacgcgggcttcttgaatacgacaaacaacgttttggatatgaactttggagacctcgatcctgccaacaacgccatgatgatcccggctggagtgcagatgcgaggccgcgctggaagcaacatgtccatgggcaacaatggccgcatgatggttaacggcggaaccatgaatggccatatgaacggcatggcgcaacagcgtccctttttctttgacacccattgctaccggatcagatcctaaagcgtcttgctaatgaaatgaggagcgccaagctccaggctcaagatctgaatcgcacgagccagttcatcaacactctcctatccaaagacgacctaaagggacgttgagaaacttgaagctttcggaacngtcgaaacctcagaccatggtcaacggcaatctttcttccggtcagacccaangcgcgcttttncgatccttctgcaccaccgnctcaacagcctcttcccgaaaagccagatgtgccctt

SEQ ID NO: 7834 - DNA, 166 bp, Tricoderma reesei
  misc_feature (1)...(166): n = A,T,C or G
naagaccnaaggcgctgcccccaaggtcaagttcngntctgtcacnccagctaccangacatgaattaaccgatgccntttgtcnatntcaaggatcgcaatgggttccagtcgtanagtttnttgaagaagtnttntcaagggccaacnacacctttgaaccgtg

SEQ ID NO: 7835 - DNA, 156 bp, Tricoderma reesei
  misc_feature (1)...(156): n = A,T,C or G
naccgcctgggtgacntctagntttccggactgngttaagctttagcctggatgaccccaacnaaatgnccggtgcatccccttttngagaagtccggtgccatcaacngatcctntnttcaagaatgggttttcttttcagtcgccgaagaacct

SEQ ID NO: 7836 - DNA, 665 bp, Tricoderma reesei
  misc_feature (1)...(665): n = A,T,C or G
atccgcgcttgaacccgggcagtctgtctcgacgaccgcgtagtccaacgactgctccgggtgcagcgaggagcatggcagaggagaaccgggatatcgtgggcgatctgccgtccacggggaagaattacaacgaggagctagccaagccagacctcgcatctatccgaaagcccagcttctctgccgcgcagagcatcgacatctctgaccatgacggcctccacatcattcttccgtcctcggcgtcgcgggccacagcagcgggctgttgcgaaacctcaaaaattgngtcattgacctttcgatacccacaagcccaggggcgcaccattnccgggttttatattgaaggatttcgacaggtgtcttattgtgggcanggcagaagtgaaccgggccttnttcatatcaaacgacgtngacccaacangcattcttcgtccgtttgtnanccccgaaaanggttcgggattccattaacttgggnaagaaaccgtcgntatattttaatttgggncttggggcccaggcncacccccnaatttattcgaaaaaaaattggttttnggggccatngcccccntttngcttttctttttnggccggggagtntttttattttttaacccgggaggggnccccaccnaaanttcggaatccgg

SEQ ID NO: 7837 - DNA, 351 bp, Tricoderma reesei
  misc_feature (1)...(351): n = A,T,C or G
aagaagatccagcgtggattctgatgatagcctcctgtcagcaggctctctcagcccagtcacggcaagaaggcgcgaaaatcgcatgtcaacgggtagcggtcgcaacaggtcccttgtatcactgggctccattgccgaagagcccaaaacaccgggcccagaggagggctcccatccagtggccacgggcggctacatgaagaacggngccggctttggtcgtgcaaagagccccgcgattgacaaggcgagcacctcatgatgaaagggagcttangttgntggaaaagcatgggcatgtnaatgaccaaatcnagtntattaaaatccgaaccgcnggacattgga

SEQ ID NO: 7838 - DNA, 173 bp, Tricoderma reesei
  misc_feature (1)...(173): n = A,T,C or G
nacntgtccttgncaataactgnctngtccaagcgcctnctacatcattnatcancgtgcgatcgggaaagcattgctaccganacaggatcngtgtgtgacgactggtggaaatgtagatcgngtcatttggatnagatantttttccataacgaaaacactgaggaactag

SEQ ID NO: 7839 - DNA, 112 bp, Tricoderma reesei
  misc_feature (1)...(112): n = A,T,C or G
nnacttcccaatggcattntggactgnttcggctnccttngtgaaaccgacctaagngtgagggnattngaccaattanataagcaactaggcccnttatgcnttcagcgag

SEQ ID NO: 7840 - DNA, 154 bp, Tricoderma reesei
  misc_feature (1)...(154): n = A,T,C or G
ttctctcttcaaccgccaaaatggtatctttccgccccatttctcgctccatctctctcgcctcgcgagctttccctttttttctgggctttttcgcgccangttttcacttcccgggnctttggcngttccaaagtgggngntttcttcttct

SEQ ID NO: 7841 - DNA, 370 bp, Tricoderma reesei
  misc_feature (1)...(370): n = A,T,C or G
ngaaccaacccacttgnttggccccaanaaccaacccggtgncccaaaaaccaattggttggcnangctttcgttnggtcagctttttccttcnccggtcccagaaaccatttacccaanccaaccacccccccgntgggccccgttggggttttnggtacttnggggnttggtcccccttttccgggtngggaaacnggnactaactcacgggggntttccaattggttcccnncaaacgccgggtttttgttttnttggccgggcctngcaatgttcgntttngggggccttttggcctnaagggnacttttcaattntgtttttngaaaanccgggggnaaacnggtatttaaaaaaananaaaaaa

SEQ ID NO: 7842 - DNA, 395 bp, Tricoderma reesei
  misc_feature (1)...(395): n = A,T,C or G
gggctagctctcttgcagtggcttgtggtatataaacagcccgacgcccagccctacctgcgaccatcgttccttcgcgctctgcattcttcacgatttcctacatcaatcgcatcaccgctttcgccacgcactgctttctatcaggcagacgacgatctcatcacacacatcaaacacaacacacacagctctcatcacaatggctgaacacctcaacgttcttatctcgaccttcaagggtctcggccttccaccgaccttggtcttgcgcacagctccatcgactacggtgacctctctgcgacaacagattgatggcaaactgccttcccggcgccaccggaatcaaagctcntcatcacaacaaccttcaaaatngagagctggcncca

SEQ ID NO: 7843 - DNA, 472 bp, Tricoderma reesei
  misc_feature (1)...(472): n = A,T,C or G
nnagcgccgaatcggcacgagggatagcgaacctccccgtcctaattacatcagaggacacactctagccgatttagggaggcaaaccggacatctgggtttcatccagacctcgcatgatctccgacttctaagtttccgggttttggaccagagcagagaggctgagcacggnaaacggtccgctggtggaagctggacccctttagctctacattctccctcccgtatcatttatcactggaatttctcggcttctaatcagatcattcgctttctgtctgattcaattcttgttgctttcttcccgcttncaatctgaaattngcaagctttgagctgggcggaattggctggcatcgacctttacgactcgagtncagtgacnacttttcgacagcgcattcgaatggggccgtctaaggagccatgtctttnaagttgatgggttggtcgcggccctttgcctggc

SEQ ID NO: 7844 - DNA, 621 bp, Tricoderma reesei
  misc_feature (1)...(621): n = A,T,C or G
ngcagacattctcggacttgttggcgattcggcctgtttctgacctgcaatagcctccttctggaatttgcataccgcggctgctgcgacagcgtctcatctcatatacgagccctactttctcccgtcctggcctctgctcagcttactctcttaattccctgcgcttctcattactactgggcaagacaagagggggcgccgccagcctctggaattggtctgcctgcagttggctttttcaccccccaaagctcaacagctacccttacctactgcttaatttcnggcccatggggcttctcgtcccgtgctaanccaccccccggaggagcagaaancctcgacnggttggcaagcaaatcgatcttccgtcgacgaaaggcaagatcgacaacgatgacgatacccaagtgatggagcccggatcaaggcaatggtaactgcgcaacaccagaatggcgggggaaggggaagatgaccttggcatgacgatgtattcgggtgctgggctcggcttatgatgctgctgcctttgcctcgccgacatcgcccgccggagtatcaaanaagaaaaagcnggaggatganggatntggtggnaatgggacaaaggaaaga

SEQ ID NO: 7845 - DNA, 223 bp, Tricoderma reesei
  misc_feature (1)...(223): n = A,T,C or G
ncgaagtaacgatcacanggctggtccttaatactacatgacnttcaaacaacacgaccgaaaacgctnccttcctccttctgttttttcccgggagcggacctctcgtncgaatacccttattcctcttttacgacaaagnactcttngcaaaacatctttgtacctttttggggtttctcggtttttatgggctaacggaatggttgttgcnggccattat

SEQ ID NO: 7846 - DNA, 465 bp, Tricoderma reesei
  misc_feature (1)...(465): n = A,T,C or G
cattttcttttccttatttgtctaacattcctctatacctctcttgcatggcgttatctgcttatcatccgttccttggctcacttgtccgacctcctttgtcttcttcactttgcaatttcaaatttctagccgggtgtgcttcctcacatatgtcccctctctctaaagacgtgttggtatatataatccacttccctggtcatgttgccctgcctctttcttttatctccccagaattttatagccatctggttcggcaaccacttattcgcatctgttgggcgaagctctaggagcttcccctctggacttctcatccgccaganggcgctnaaccgtcntttactctcatgatggcttgcccgttacgggacagcgtgttatattttccctttcnccacgaagtggcgtantnggggacttgttacaggatagctgggaatgggtnagctagganaattt

SEQ ID NO: 7847 - DNA, 404 bp, Tricoderma reesei
  misc_feature (1)...(404): n = A,T,C or G
ngttnttaattaaagggtggttngcgtacancaggattggttggccaaggcccggaaagnaccgacttccagnacccttganctttaatcganccccttttcnagcganggcaacttgnaaagccgtgacggtccctnttgttgaancaactgggcacccaacgtgatccgaacctaagcccatngaaccncaaaggcgnacacttccggctgnatgaagctggttaacgaatgccggnatntaagtttttttccgnacttgggncgaagccntttttgntcaataaacccgngacacccctggctggaacaaccggagttnnttcaaccggtttcaaggggcgtcnngtcaacaaaatgtcccantacccaaangtattnggttattttgccgggtaacgagg

SEQ ID NO: 7848 - DNA, 135 bp, Tricoderma reesei
  misc_feature (1)...(135): n = A,T,C or G
ngatccncgnactgccccaagtgccggntangatgctggcncgggcatcaatngacagtgacgatcttctcgagcaanggcgganccccggaccggatcctttatncaccgccnttcttanctcttacggggttg

SEQ ID NO: 7849 - DNA, 247 bp, Tricoderma reesei
  misc_feature (1)...(247): n = A,T,C or G
ngcgcaccaagacggtttactccatggtctttgacnaacctcgcgtttacccacattcgcctttctttgactactacttttccgaccaatnctgccngtcaccaagatcccgagaaataccgtcngactaagtnttcactggcnaangacattgggccttaactttgtcatgtccaatgttgaccggatcaagcccctttgcttggtccnagnggagcagncagtatatcaaacctggacctttagg

SEQ ID NO: 7850 - DNA, 124 bp, Tricoderma reesei
  misc_feature (1)...(124): n = A,T,C or G
gtacagcgcaccatgccccgcctccacactcgatncttacaaccttntatatcaagccattgcatcatctcancagtacgcatacccatgactatccttctttgagcgctcttgccctcntcga

SEQ ID NO: 7851 - DNA, 736 bp, Tricoderma reesei
  misc_feature (1)...(736): n = A,T,C or G
atacgcaggccatactgcgggttggtgagggcgagggcgagatggattacctcgtaatgactttcatgaccaagatggagttgcggtcgctcgtgtttactatcagcggcctggtcaactttcacaagccttcctcacagggtcgcaggtcaactgaattctggaaggaaggcttaaagattctcgaaacatgggacgcctcaacggccggcataccatacggcgcccctgttcccctaaatgtggcaatcaaacagcgggcctggcgaatagaggcacaggcttacttgactgtcctcctggggttcgtagctgcagtcactgccaatggtcaacggtcaagcagttgcttcagaatctcgagaacctggtctcgcctcgacgcagccgactgtgagattgctcttcacctatctaaagggcgtctaccaccagggcatcggcagcctgcaagcccgcctcgacatcttcctcgacgaccgttcaaggtccaacagcagggcaacacnggaattaaagccggcaacaaagaaggtgccttcttgcggcctgaaccgggtntggatcatgcacacccgtcgtgtcgaaacgccaagaaacgccggaccttattgaacaagttcagccgacttgggccaaccaaagaacatttgatnttcggacggctaccacaacgttatnggngggcctngngacggaaccgcccaanagnttaaccagnaaaagcaggacattc

SEQ ID NO: 7852 - DNA, 349 bp, Tricoderma reesei
  misc_feature (1)...(349): n = A,T,C or G
naagcccgatcngcacgaggggatggcttcagtcgtattatcactagggnattgtttcccaagccggcttcaaaacacacagataaaccaccaactctacaaccaaagactttttgatcaatccaacaacttctctcaacatgtctgctgcaaccngtcacccgcactgcaaccgccgctgttcgcagaccccggcttcttcatgcaagttccggacggatgggactcctcattcggagccaccaagccctttgagccngactcttccgtccacctatgaaagcctngcacggaccccnacctattgctaagctatgtcngtntaggaccggcttggccaagtttaggc

SEQ ID NO: 7853 - DNA, 187 bp, Tricoderma reesei
  misc_feature (1)...(187): n = A,T,C or G
nagcctattcttcanctcgnggacatgngcnggcatgtatgtggcaagttggcgcgttntcttcaacctttgttgnccacaactgaatgctctagtctctgntcactangctaatagattaactcancccaantggtcacataaanaaaatgtttactctgncgaggagngtactcatggaaagatc

SEQ ID NO: 7854 - DNA, 145 bp, Tricoderma reesei
  misc_feature (1)...(145): n = A,T,C or G
nangacccttcttacgccggttaataaccggcaaaagcaagaaaccttacttccggctntttcctcaaaaaagttcgccancggacttggtaaaggacnttaacagccaccaaataaagaanattggcagcaccgcttacccgcg

SEQ ID NO: 7855 - DNA, 283 bp, Tricoderma reesei
  misc_feature (1)...(283): n = A,T,C or G
ntctancgctctttcgaagcgccctngctacacgaagctcgacaaatggcacaccgtcatcatcgaacaggaggagacntaccattncaacatcaangcccagagcagagaggttaanccncctggagaaangaangcttgaanctgcataaacagacccgcangggaccgtggcccgctttcgagcccatcttcgtngacttgacttancaagctcgacgggccttggncaagnccttncttgctgaccnttgcaacngacgcttgttgacnggaaaagtca

SEQ ID NO: 7856 - DNA, 328 bp, Tricoderma reesei
  misc_feature (1)...(328): n = A,T,C or G
ctacccaaagaagcagacactcgagctttcgacgagcgtctgttctggattgatcaccagcttgcagctgttatcctcgagccctcgtgagtcgaacagggacaacatcgacttgctgttgcttgccgctgtcctgagcctcgcgccgcaccgcatcacgacagcttcgcccggtgtctttctgttttgttgggggaaaaaactcgtgtccaccgcaacgtagcacctgcccgtgataccgtgggcaagctctgcgacaggacctaccccgcactcggncgccttctttaagcgcatccttcggttttgccctccaaaccgtctctct

SEQ ID NO: 7857 - DNA, 733 bp, Tricoderma reesei
  misc_feature (1)...(733): n = A,T,C or G
atgaacgcgaaaaaggctgctctacctggctagtaggtattattctcaccggctgtggcagccacttgcatgcagtcaaggcctatgtgcttcgttcatatgcctgtatgttgaggtgcattgcattggattcatgtagggggtcgcttttcagtagtattaatggatcaggtaacgtacctacaagtataaacgagcagtttcagctggcagtggctgcgggctatcaggcaggtaggcatctaaggtagtagtggaagagaaacctgactgtttgcttcgggcatgtctatcagtcaaggcactattgcctacctacctactacccaataccttacctagtacctcccctgccttcaggttgatgctccctcagtacctgtgccttataaatatcacgccaggtcggtgccttgtccttgcccgaacagacatctcttgacctcgacaaccttccttctgctcgtcagaccatggccaacgaccaagatgctcttctttctcgcggagaggaattgctttctctggccgaacaacctcctttctttgcggaagtcagccttgccgctaggcagccatgacgtgggagatcatgtgcttggcttcatcgacactttccgcgatcctnttnagggcgcgaatatntttacttttaanggtgacctcagcgantccttaagttcatcatcaatccgaatttnattntcccttttacggggggaggatnacaatg

SEQ ID NO: 7858 - DNA, 156 bp, Tricoderma reesei
  misc_feature (1)...(156): n = A,T,C or G
ncacagccttgcaaaatngtgggaatnggccaagaacactcaaactattctttaccctcccatgnatgtntaacnataaccngatntaaaaaaaaaangaggcgtacccaaacnncatcaacnaagacgttnttctacgncccagccntctggctt

SEQ ID NO: 7859 - DNA, 240 bp, Tricoderma reesei
  misc_feature (1)...(240): n = A,T,C or G
nctgncgattcgnacgangcactggatanccagtaatttcacancagtctatttgagcatattcatcacttatncaacacacttcagacccatcacnatgtnttttcgatcaaacaactccgttgtcatcatcggctctggcccaggcattggttcgtacacagccgccatcttcacttncaaccaatttaacaaggncgcacctngtggctanaaagctctgnccatctggagaaagat

SEQ ID NO: 7860 - DNA, 217 bp, Tricoderma reesei
  misc_feature (1)...(217): n = A,T,C or G
cgtccatccttggaaatggccaagaggagtctatcctgcccgcagatttcatcatgcctcacgagaacaactacttgtcgtctcccccgggggtaattatcgagttgcagtcgctggagctgggcacgccgatagcagagtgcgtncacccgacgcctctggcagaaatcgtcgtgactcccatccatgagaaccatcgggctccggatctgccttc
